US009969800B2

(12) United States Patent
Igawa et al.

(10) Patent No.: US 9,969,800 B2
(45) Date of Patent: May 15, 2018

(54) IL-8 ANTIBODIES

(71) Applicant: Chugai Seiyaku Kabushiki Kaisha, Tokyo (JP)

(72) Inventors: Tomoyuki Igawa, Shizuoka (JP); Atsuhiko Maeda, Shizuoka (JP); Genki Nakamura, Shizuoka (JP); Masaru Muraoka, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 0 days. days.

(21) Appl. No.: 15/015,287

(22) Filed: Feb. 4, 2016

(65) Prior Publication Data
US 2016/0229908 A1 Aug. 11, 2016

(30) Foreign Application Priority Data

Feb. 5, 2015 (JP) .................................. 2015-021371
Sep. 18, 2015 (JP) .................................. 2015-185254

(51) Int. Cl.
*C07K 16/24* (2006.01)
*C07K 16/18* (2006.01)
*C07K 16/28* (2006.01)
*C07K 16/42* (2006.01)
*C07K 16/36* (2006.01)
*A61K 39/00* (2006.01)

(52) U.S. Cl.
CPC ............ *C07K 16/244* (2013.01); *C07K 16/18* (2013.01); *C07K 16/2866* (2013.01); *C07K 16/36* (2013.01); *C07K 16/4291* (2013.01); A61K 2039/505 (2013.01); C07K 2317/24 (2013.01); C07K 2317/31 (2013.01); C07K 2317/51 (2013.01); C07K 2317/515 (2013.01); C07K 2317/52 (2013.01); C07K 2317/55 (2013.01); C07K 2317/56 (2013.01); C07K 2317/76 (2013.01); C07K 2317/77 (2013.01); C07K 2317/90 (2013.01); C07K 2317/92 (2013.01); C07K 2317/94 (2013.01)

(58) Field of Classification Search
CPC .................................................. C07K 16/244
See application file for complete search history.

(56) References Cited

U.S. PATENT DOCUMENTS

| 4,801,687 | A | 1/1989 | Ngo |
| 5,322,678 | A | 6/1994 | Morgan, Jr. et al. |
| 5,639,641 | A | 6/1997 | Pedersen et al. |
| 5,795,965 | A | 8/1998 | Tsuchiya et al. |
| 5,827,733 | A | 10/1998 | Lee et al. |
| 5,935,935 | A | 8/1999 | Connelly et al. |
| 5,990,286 | A | 11/1999 | Khawli et al. |
| 6,024,956 | A | 2/2000 | Matsushima et al. |
| 6,096,506 | A | 8/2000 | Lee et al. |
| 6,165,745 | A | 12/2000 | Ward et al. |
| 6,245,894 | B1 | 6/2001 | Matsushima et al. |
| 6,329,511 | B1 | 12/2001 | Vasquez et al. |
| 6,485,943 | B2 | 11/2002 | Stevens et al. |
| 6,677,436 | B1 | 1/2004 | Sato et al. |
| 6,737,056 | B1 | 5/2004 | Presta |
| 6,821,505 | B2 | 11/2004 | Ward |
| 6,884,879 | B1 | 4/2005 | Baca et al. |
| 6,913,747 | B1 | 7/2005 | Co et al. |
| 7,052,873 | B2 | 5/2006 | Tsuchiya |
| 7,247,302 | B1 | 7/2007 | Rosok et al. |
| 7,261,893 | B2 | 8/2007 | Veldman et al. |
| 7,276,585 | B2 | 10/2007 | Lazar et al. |
| 7,320,789 | B2 | 1/2008 | Aghajanian et al. |
| 7,358,054 | B2 | 4/2008 | Karpusas et al. |
| 7,365,166 | B2 | 4/2008 | Baca et al. |
| 7,371,826 | B2 | 5/2008 | Presta |
| 7,615,213 | B2 | 11/2009 | Kasaian et al. |
| 7,662,925 | B2 | 2/2010 | Lazar et al. |
| 7,670,600 | B2 | 3/2010 | Dall'Acqua et al. |
| 7,785,791 | B2 | 8/2010 | Presta |
| 7,807,159 | B2 | 10/2010 | Chin et al. |
| 7,888,486 | B2 | 2/2011 | Walsh et al. |
| 7,955,590 | B2 | 6/2011 | Gillies et al. |
| 7,960,512 | B2 | 6/2011 | Stavenhagen et al. |
| 8,062,635 | B2 | 11/2011 | Hattori et al. |
| 8,063,187 | B2 | 11/2011 | Chu et al. |
| 8,101,720 | B2 | 1/2012 | Lazar et al. |
| 8,147,829 | B2 | 4/2012 | Hariharan et al. |
| 8,323,962 | B2 | 12/2012 | Dall'Acqua et al. |
| 8,497,355 | B2 | 7/2013 | Igawa et al. |
| 8,562,991 | B2 | 10/2013 | Igawa et al. |

(Continued)

FOREIGN PATENT DOCUMENTS

AU 2011244851 A1 11/2011
CA 2647846 A1 10/2007

(Continued)

OTHER PUBLICATIONS

Idusogie, E. E., et al., "Engineered Antibodies with Increased Activity to Recruit Complement," *The Journal of Immunology*; 166:2571-2575 (2001).
Kingsley, D. M., "The TGF-β superfamily: new members, new receptors, and new genetic tests of function in different organisms," *Genes & Development*; 8: 133-146 (1994).
Hoodless, P. A., et al., "Mechanism and Function of Signaling by the TGFβ Superfamily," *Current Topics in Microbiology and Immunology*; 228: 235-272 (1998).
Zimmers, T. A., et al., "Induction of Cachexia in Mice by Systemically Administered Myostation," *Science*; 296: 1486-1488 (May 24, 2002).
McPherron, A. C., et al., "Regulation of skeletal muscle mass in mice by a new TGF-β superfamily member," *Nature*; 387: 83-90 (May 1997).

(Continued)

*Primary Examiner* — Prema Mertz
(74) *Attorney, Agent, or Firm* — Nixon & Vanderhye P.C.

(57) ABSTRACT

One nonexclusive aspect provides molecules further improved from antibodies that can bind to antigens in an ion concentration-dependent manner. An alternative nonexclusive aspect provides safe and more advantageous Fc region variants that have decreased binding to pre-existing ADA. An alternative nonexclusive aspect provides novel IL-8 antibodies that are superior as pharmaceuticals.

36 Claims, 29 Drawing Sheets

(56) References Cited

U.S. PATENT DOCUMENTS

| | | |
|---|---|---|
| 8,637,641 B2 | 1/2014 | Dahiyat et al. |
| 8,685,725 B2 | 4/2014 | Beliard et al. |
| 8,753,629 B2 | 6/2014 | Lazar et al. |
| 9,051,373 B2 | 6/2015 | Lazar et al. |
| 9,079,949 B1 | 7/2015 | Andrien, Jr. et al. |
| 9,096,651 B2 | 8/2015 | Igawa et al. |
| 9,605,061 B2 | 3/2017 | Lazar et al. |
| 2002/0137897 A1 | 9/2002 | Stevens et al. |
| 2002/0142374 A1 | 10/2002 | Gallo et al. |
| 2002/0164339 A1 | 11/2002 | Do et al. |
| 2003/0059937 A1 | 3/2003 | Ruben et al. |
| 2003/0103970 A1 | 6/2003 | Tsuchiya |
| 2003/0138422 A1 | 7/2003 | Aghajanian et al. |
| 2003/0224397 A1 | 12/2003 | Lowman et al. |
| 2004/0081651 A1 | 4/2004 | Karpusas et al. |
| 2004/0110226 A1 | 6/2004 | Lazar et al. |
| 2004/0132101 A1 | 7/2004 | Lazar et al. |
| 2004/0133357 A1 | 7/2004 | Zhong et al. |
| 2004/0142382 A1 | 7/2004 | Veldman et al. |
| 2004/0236080 A1 | 11/2004 | Aburatani et al. |
| 2005/0054832 A1 | 3/2005 | Lazar et al. |
| 2005/0064514 A1 | 3/2005 | Stavenhagen et al. |
| 2005/0095243 A1 | 5/2005 | Chan et al. |
| 2005/0244403 A1 | 11/2005 | Lazar et al. |
| 2005/0260213 A1 | 11/2005 | Koenig et al. |
| 2005/0260711 A1 | 11/2005 | Datta et al. |
| 2005/0261229 A1 | 11/2005 | Gillies et al. |
| 2006/0014156 A1 | 1/2006 | Rabbani et al. |
| 2006/0019342 A1 | 1/2006 | Dall'Acqua et al. |
| 2006/0024298 A1 | 2/2006 | Lazar et al. |
| 2006/0063228 A1 | 3/2006 | Kasaian et al. |
| 2006/0141456 A1 | 6/2006 | Edwards et al. |
| 2006/0153860 A1 | 7/2006 | Cho et al. |
| 2006/0194291 A1 | 8/2006 | Presta |
| 2006/0198840 A1 | 9/2006 | Dall'Acqua et al. |
| 2006/0263354 A1 | 11/2006 | Chin et al. |
| 2007/0003546 A1 | 1/2007 | Lazar et al. |
| 2007/0009523 A1 | 1/2007 | Presta |
| 2007/0036785 A1 | 2/2007 | Kishimoto et al. |
| 2007/0037734 A1 | 2/2007 | Rossi et al. |
| 2007/0041978 A1 | 2/2007 | Hattori et al. |
| 2007/0059312 A1 | 3/2007 | Baca et al. |
| 2007/0087000 A1 | 4/2007 | Walsh et al. |
| 2007/0148164 A1 | 6/2007 | Farrington et al. |
| 2007/0160598 A1 | 7/2007 | Dennis et al. |
| 2007/0190056 A1 | 8/2007 | Kambadur et al. |
| 2007/0231329 A1 | 10/2007 | Lazar et al. |
| 2007/0248602 A1 | 10/2007 | Lazar et al. |
| 2008/0044417 A1 | 2/2008 | Johnson et al. |
| 2008/0089892 A1 | 4/2008 | Allan et al. |
| 2008/0138349 A1 | 6/2008 | Stavenhagen et al. |
| 2008/0166756 A1 | 7/2008 | Tsuchiya et al. |
| 2008/0199471 A1 | 8/2008 | Bernett et al. |
| 2008/0274506 A1 | 11/2008 | Presta |
| 2009/0041770 A1 | 2/2009 | Chamberlain et al. |
| 2009/0042291 A1 | 2/2009 | Chu et al. |
| 2009/0053211 A9 | 2/2009 | Lazar et al. |
| 2009/0053240 A1 | 2/2009 | Lazar et al. |
| 2009/0076251 A1 | 3/2009 | Koenig et al. |
| 2009/0136485 A1 | 5/2009 | Chu et al. |
| 2009/0263392 A1 | 10/2009 | Igawa et al. |
| 2009/0324589 A1 | 12/2009 | Igawa et al. |
| 2010/0098710 A1 | 4/2010 | Hariharan et al. |
| 2010/0098730 A1 | 4/2010 | Lowman et al. |
| 2010/0099147 A1 | 4/2010 | Hariharan et al. |
| 2010/0184959 A1 | 7/2010 | Guler-Gane et al. |
| 2010/0216187 A1 | 8/2010 | Lasters et al. |
| 2010/0239577 A1 | 9/2010 | Igawa et al. |
| 2010/0249482 A1 | 9/2010 | Chung et al. |
| 2010/0292443 A1 | 11/2010 | Sabbadini et al. |
| 2010/0298542 A1 | 11/2010 | Igawa et al. |
| 2011/0021755 A1 | 1/2011 | Lazar et al. |
| 2011/0027276 A1 | 2/2011 | Bernett et al. |
| 2011/0044986 A1 | 2/2011 | Biere-Citron et al. |
| 2011/0076275 A1 | 3/2011 | Igawa et al. |
| 2011/0098450 A1 | 4/2011 | Igawa et al. |
| 2011/0111406 A1 | 5/2011 | Igawa et al. |
| 2011/0150888 A1 | 6/2011 | Foltz et al. |
| 2011/0223658 A1 | 9/2011 | Beliard et al. |
| 2011/0229489 A1 | 9/2011 | Pons et al. |
| 2011/0245473 A1 | 10/2011 | Igawa et al. |
| 2011/0311454 A1 | 12/2011 | Dall'Acqua et al. |
| 2012/0009188 A1 | 1/2012 | Behrens et al. |
| 2012/0028304 A1 | 2/2012 | Dahiyat et al. |
| 2012/0070446 A1 | 3/2012 | Beaumont et al. |
| 2013/0011866 A1 | 1/2013 | Igawa et al. |
| 2013/0303396 A1 | 11/2013 | Igawa et al. |
| 2013/0336963 A1 | 12/2013 | Igawa et al. |
| 2014/0093496 A1 | 4/2014 | Mimoto et al. |
| 2014/0105889 A1 | 4/2014 | Igawa et al. |
| 2014/0199294 A1 | 7/2014 | Mimoto et al. |
| 2014/0234340 A1 | 8/2014 | Igawa et al. |
| 2014/0249297 A1 | 9/2014 | Lazar et al. |
| 2014/0255398 A1 | 9/2014 | Igawa et al. |
| 2014/0294833 A1 | 10/2014 | Desjarlais et al. |
| 2014/0335089 A1 | 11/2014 | Igawa et al. |
| 2014/0363426 A1 | 12/2014 | Moore et al. |
| 2014/0363428 A1 | 12/2014 | Igawa et al. |
| 2015/0050269 A1 | 2/2015 | Igawa et al. |
| 2015/0166636 A1 | 6/2015 | Igawa et al. |
| 2015/0166654 A1 | 6/2015 | Igawa et al. |
| 2015/0203577 A1 | 7/2015 | Igawa et al. |
| 2015/0210763 A1 | 7/2015 | Kuramochi et al. |
| 2015/0284465 A1 | 10/2015 | Igawa et al. |
| 2015/0299296 A1 | 10/2015 | Igawa et al. |
| 2015/0299313 A1 | 10/2015 | Igawa et al. |
| 2015/0315278 A1 | 11/2015 | Igawa et al. |
| 2015/0344570 A1 | 12/2015 | Igawa et al. |
| 2015/0353630 A1 | 12/2015 | Igawa et al. |
| 2016/0039912 A1 | 2/2016 | Igawa et al. |
| 2016/0046693 A1 | 2/2016 | Igawa et al. |
| 2016/0200807 A1 | 7/2016 | Igawa et al. |
| 2016/0229908 A1 | 8/2016 | Igawa et al. |
| 2017/0022270 A1 | 1/2017 | Igawa et al. |

FOREIGN PATENT DOCUMENTS

| | | |
|---|---|---|
| CA | 2700986 A1 | 4/2009 |
| CN | 1763097 A | 4/2006 |
| CN | 101014619 A | 8/2007 |
| CN | 101277976 A | 10/2008 |
| CN | 101282992 A | 10/2008 |
| CN | 102056946 A | 5/2011 |
| CN | 101001873 B | 3/2013 |
| CN | 103492565 A | 1/2014 |
| CN | 102633880 B | 2/2015 |
| EP | 0182495 A1 | 5/1986 |
| EP | 0 770 628 A1 | 5/1997 |
| EP | 0783893 A1 | 7/1997 |
| EP | 1069185 A1 | 1/2001 |
| EP | 0770628 B1 | 9/2006 |
| EP | 1773391 A2 | 4/2007 |
| EP | 1601697 B1 | 5/2007 |
| EP | 1870459 A1 | 12/2007 |
| EP | 2006381 A1 | 12/2008 |
| EP | 2009101 A1 | 12/2008 |
| EP | 2 202 245 A1 | 6/2010 |
| EP | 2196541 A1 | 6/2010 |
| EP | 2275443 A1 | 1/2011 |
| EP | 1069185 B1 | 6/2011 |
| EP | 2 368 911 A1 | 9/2011 |
| EP | 2 431 393 A1 | 3/2012 |
| EP | 20130186545 | 9/2013 |
| EP | 2 679 681 A1 | 1/2014 |
| EP | 2698431 A1 | 2/2014 |
| EP | 2 762 166 A1 | 8/2014 |
| EP | 2 762 493 A1 | 8/2014 |
| EP | 2 762 564 A1 | 8/2014 |
| EP | 2 818 183 A1 | 12/2014 |
| EP | 2 853 898 A1 | 4/2015 |
| EP | 2853898 A1 | 4/2015 |
| EP | 2889377 A1 | 7/2015 |
| EP | 2940043 A1 | 11/2015 |
| EP | 2853898 B1 | 1/2017 |

(56) References Cited

FOREIGN PATENT DOCUMENTS

| | | |
|---|---|---|
| JP | S61117457 A | 6/1986 |
| JP | S6352890 A | 3/1988 |
| JP | H0228200 A | 1/1990 |
| JP | H02163085 A | 6/1990 |
| JP | H0767688 A | 3/1995 |
| JP | H09217799 A | 8/1996 |
| JP | 2003512019 A | 4/2003 |
| JP | 2004511426 A | 4/2004 |
| JP | 2005535341 A | 11/2005 |
| JP | 2006512407 A | 4/2006 |
| JP | 2006519583 A | 8/2006 |
| JP | 2007532139 A | 11/2007 |
| JP | 2008511292 A | 4/2008 |
| JP | 2010505436 A | 2/2010 |
| JP | 2010514460 A | 5/2010 |
| JP | 2011504096 A | 2/2011 |
| JP | 2012512641 A | 6/2012 |
| JP | 5055603 B2 | 10/2012 |
| JP | 5144499 B2 | 2/2013 |
| JP | 2013518131 A | 5/2013 |
| JP | 2013165716 A | 8/2013 |
| JP | 2013531486 A | 8/2013 |
| JP | 5334319 B2 | 11/2013 |
| JP | 5357778 B2 | 12/2013 |
| JP | 2015130883 A | 7/2015 |
| RU | 2225721 C2 | 3/2004 |
| RU | 2236222 C2 | 9/2004 |
| RU | 2266298 C2 | 12/2005 |
| RU | 2005112742 A | 1/2006 |
| RU | 2337107 C2 | 10/2008 |
| RU | 2390527 C2 | 5/2010 |
| RU | 2430111 C1 | 9/2011 |
| RU | 2010116152 A | 11/2011 |
| RU | 2505603 C2 | 1/2014 |
| SG | 192945 A1 | 9/2013 |
| TW | 416960 B | 1/2001 |
| TW | 201202419 A | 1/2012 |
| WO | WO 91/13631 | 9/1991 |
| WO | WO-9219759 A1 | 11/1992 |
| WO | WO 94/21681 | 9/1994 |
| WO | WO-9514710 A1 | 6/1995 |
| WO | WO 96/02576 | 2/1996 |
| WO | WO-9611020 A1 | 4/1996 |
| WO | WO-9612503 A1 | 5/1996 |
| WO | WO-9803546 A1 | 1/1998 |
| WO | WO-9805787 A1 | 2/1998 |
| WO | WO-9918212 A1 | 4/1999 |
| WO | WO-9951642 A1 | 10/1999 |
| WO | WO-9951743 A1 | 10/1999 |
| WO | WO-9958572 A1 | 11/1999 |
| WO | WO-0014220 A | 3/2000 |
| WO | WO-0015214 A1 | 3/2000 |
| WO | WO 00/42072 | 7/2000 |
| WO | WO-0130854 A2 | 5/2001 |
| WO | WO-0182899 A2 | 11/2001 |
| WO | WO 02/09641 A2 | 2/2002 |
| WO | WO-02060919 A2 | 8/2002 |
| WO | WO-03000883 A1 | 1/2003 |
| WO | WO-03020949 A2 | 3/2003 |
| WO | WO-03027248 A2 | 4/2003 |
| WO | WO-03070760 A2 | 8/2003 |
| WO | WO-03074679 A2 | 9/2003 |
| WO | WO-03105757 A2 | 12/2003 |
| WO | WO-03107009 A2 | 12/2003 |
| WO | WO-2004016740 A2 | 2/2004 |
| WO | WO 2004/024890 A2 | 3/2004 |
| WO | WO 2004/029207 A2 | 4/2004 |
| WO | WO 2004/037861 A2 | 5/2004 |
| WO | WO-2004039826 A1 | 5/2004 |
| WO | WO-2004058797 A2 | 7/2004 |
| WO | WO-2004068931 A2 | 8/2004 |
| WO | WO 2004/099249 A2 | 11/2004 |
| WO | WO-2004096273 A1 | 11/2004 |
| WO | WO 2004/108157 A2 | 12/2004 |
| WO | WO-2005035756 A1 | 4/2005 |
| WO | WO-2005047327 A2 | 5/2005 |
| WO | WO-2005056759 A2 | 6/2005 |
| WO | WO-2005059106 A2 | 6/2005 |
| WO | WO-2005067620 A2 | 7/2005 |
| WO | WO-2005077981 A2 | 8/2005 |
| WO | WO 2005/094446 A2 | 10/2005 |
| WO | WO-2005092925 A2 | 10/2005 |
| WO | WO-2005112564 A2 | 12/2005 |
| WO | WO-2005115452 A2 | 12/2005 |
| WO | WO-2005123126 A2 | 12/2005 |
| WO | WO 2006/004663 A2 | 1/2006 |
| WO | WO 2006/019447 A1 | 2/2006 |
| WO | WO 2006/020114 A2 | 2/2006 |
| WO | WO-2006030200 A1 | 3/2006 |
| WO | WO-2006030220 A1 | 3/2006 |
| WO | WO-2006031370 A2 | 3/2006 |
| WO | WO 2006/047350 A2 | 5/2006 |
| WO | WO-2006050166 A2 | 5/2006 |
| WO | WO-2006050491 A2 | 5/2006 |
| WO | WO-2006053301 A2 | 5/2006 |
| WO | WO-2006066598 A2 | 6/2006 |
| WO | WO-2006067913 A1 | 6/2006 |
| WO | WO 2006/076594 A2 | 7/2006 |
| WO | WO-2006071877 A2 | 7/2006 |
| WO | WO 2006/083182 A1 | 8/2006 |
| WO | WO 2006/083183 A1 | 8/2006 |
| WO | WO-2006085967 A2 | 8/2006 |
| WO | WO 2006/102095 A2 | 9/2006 |
| WO | WO 2006/113643 A2 | 10/2006 |
| WO | WO-2006105338 A2 | 10/2006 |
| WO | WO-2006106905 A1 | 10/2006 |
| WO | WO-2006109592 A1 | 10/2006 |
| WO | WO-2006116269 A2 | 11/2006 |
| WO | WO-2006121852 A2 | 11/2006 |
| WO | WO 2007/001422 A2 | 1/2007 |
| WO | WO-2007008943 A2 | 1/2007 |
| WO | WO-2007024249 A2 | 3/2007 |
| WO | WO-2007024535 A2 | 3/2007 |
| WO | WO 2007/047112 A2 | 4/2007 |
| WO | WO-2007041635 A2 | 4/2007 |
| WO | WO-2007044411 A2 | 4/2007 |
| WO | WO-2007044616 A2 | 4/2007 |
| WO | WO-2007060411 A1 | 5/2007 |
| WO | WO-2007076524 A2 | 7/2007 |
| WO | WO-2007092772 A2 | 8/2007 |
| WO | WO 2007/114319 A1 | 10/2007 |
| WO | WO-2007114325 A1 | 10/2007 |
| WO | WO-2007142325 A2 | 12/2007 |
| WO | WO-2008002933 A2 | 1/2008 |
| WO | WO-2008022152 A2 | 2/2008 |
| WO | WO-2008030706 A2 | 3/2008 |
| WO | WO-2008036688 A2 | 3/2008 |
| WO | WO-2008043822 A2 | 4/2008 |
| WO | WO-2008060785 A2 | 5/2008 |
| WO | WO-2008091798 A2 | 7/2008 |
| WO | WO-2008091954 A2 | 7/2008 |
| WO | WO-2008092117 A2 | 7/2008 |
| WO | WO-2008098115 A2 | 8/2008 |
| WO | WO-2008121160 A2 | 10/2008 |
| WO | WO-2008130969 A2 | 10/2008 |
| WO | WO-2008150494 A1 | 12/2008 |
| WO | WO-2009000098 A2 | 12/2008 |
| WO | WO-2009000099 A2 | 12/2008 |
| WO | WO-2009006338 A1 | 1/2009 |
| WO | WO-2009026117 A2 | 2/2009 |
| WO | WO-2009032145 A1 | 3/2009 |
| WO | WO-2009032782 A2 | 3/2009 |
| WO | WO 2009/041643 A1 | 4/2009 |
| WO | WO-2009041062 A1 | 4/2009 |
| WO | WO 2009/062083 A2 | 5/2009 |
| WO | WO-2009058346 A1 | 5/2009 |
| WO | WO-2009058492 A2 | 5/2009 |
| WO | WO-2009086320 A1 | 7/2009 |
| WO | WO 2009/125825 A1 | 10/2009 |
| WO | WO-2009139822 A1 | 11/2009 |
| WO | WO-2009155513 A2 | 12/2009 |
| WO | WO-2010033736 A1 | 3/2010 |
| WO | WO-2010045193 A1 | 4/2010 |
| WO | WO 2010/070094 A1 | 6/2010 |

(56) References Cited

FOREIGN PATENT DOCUMENTS

| | | |
|---|---|---|
| WO | WO-2010107109 A1 | 9/2010 |
| WO | WO 2010/151338 A2 | 12/2010 |
| WO | WO-2011021009 A1 | 2/2011 |
| WO | WO-2011094593 A2 | 8/2011 |
| WO | WO-2011100271 A2 | 8/2011 |
| WO | WO-2011111007 A2 | 9/2011 |
| WO | WO 2011/122011 A2 | 10/2011 |
| WO | WO 2011/151432 A1 | 12/2011 |
| WO | WO-2011150008 A1 | 12/2011 |
| WO | WO 2012/016227 A2 | 2/2012 |
| WO | WO-2012024242 A1 | 2/2012 |
| WO | WO 2012/073992 A1 | 6/2012 |
| WO | WO 2012/093704 A1 | 7/2012 |
| WO | WO 2012/115241 A1 | 8/2012 |
| WO | WO-2012132067 A1 | 10/2012 |
| WO | WO-2012133782 A1 | 10/2012 |
| WO | WO-2013012733 A1 | 1/2013 |
| WO | WO 2013/046704 A | 4/2013 |
| WO | WO 2013/046722 A1 | 4/2013 |
| WO | WO 2013/047752 A1 | 4/2013 |
| WO | WO-2013047729 A1 | 4/2013 |
| WO | WO-2013047748 A1 | 4/2013 |
| WO | WO 2013/081143 A1 | 6/2013 |
| WO | WO 2013/125667 A1 | 8/2013 |
| WO | WO-2013138680 A1 | 9/2013 |
| WO | WO-2013152001 A2 | 10/2013 |
| WO | WO-2013166099 A1 | 11/2013 |
| WO | WO-2013186719 A1 | 12/2013 |
| WO | WO-2014006217 A1 | 1/2014 |
| WO | WO 2014/030728 A1 | 2/2014 |
| WO | WO 2014/030750 A1 | 2/2014 |
| WO | WO-2014028354 A1 | 2/2014 |
| WO | WO 2014/074532 A2 | 5/2014 |
| WO | WO-2014114651 A1 | 7/2014 |
| WO | WO 2014/144903 A1 | 9/2014 |
| WO | WO 2014/145159 A2 | 9/2014 |
| WO | WO-2014144080 A2 | 9/2014 |
| WO | WO-2014144575 A1 | 9/2014 |
| WO | WO-2014145806 A2 | 9/2014 |
| WO | WO 2014/163101 A1 | 10/2014 |
| WO | WO 2014/182676 A2 | 11/2014 |
| WO | WO-2014184384 A1 | 11/2014 |
| WO | WO-2014190441 A1 | 12/2014 |
| WO | WO-2015022658 A2 | 2/2015 |
| WO | WO-2015111008 A2 | 7/2015 |
| WO | WO 2015/162590 A1 | 10/2015 |
| WO | WO-2016073853 A1 | 5/2016 |
| WO | WO-2016073879 A2 | 5/2016 |
| WO | WO-2016073906 A2 | 5/2016 |
| WO | WO 2016/098357 A1 | 6/2016 |
| WO | WO-2016092439 A1 | 6/2016 |
| WO | WO-2016125495 A1 | 8/2016 |
| WO | WO-2016168613 A1 | 10/2016 |
| WO | WO-2017046994 A1 | 3/2017 |
| WO | WO-2017049011 A1 | 3/2017 |
| WO | WO-2017104783 A1 | 6/2017 |
| WO | WO-2017120523 A2 | 7/2017 |

OTHER PUBLICATIONS

McPherron, A. C., et al., "Double muscling in cattle due to mutations in the myostatin gene," *Proc. Natl. Acad. Sci. USA*; 94: 12457-12461 (Nov. 1997).

Szláma, G., et al., "Latent myostatin has significant activity and this activity is controlled more efficiently by WFIKKN1 than by WFIKKN2," *The FEBS Journal*; 280: 3822-3839 (2013).

Lee, S.-J., "Genetic Analysis of the Role of Proteolysis in the Activation of Latent Myostatin," *PLoS ONE*; 3(2): e1628 (Feb. 2008).

Lee, S.-J., et al., "Regulation of myostatin activity and muscle growth," *PNAS*; 98(16): 9306-9311 (Jul. 31, 2001).

McCroskery, S., et al., "Improved muscle healing through enhanced regeneration and reduced fibrosis in myostatin-null mice," *Journal of Cell Science*; 118: 3531-3541 (2005).

Whittemore, L.-A., et al., "Inhibition of myostatin in adult mice increases skeletal muscle mass and strength," *Biochemical and Biophysical Research Communications*; 300: 965-971 (2003).

Bogdanovich, S., et al., "Functional improvement of dystrophic muscle by myostatin blockade," *Nature*; 420: 418-421 (Nov. 28, 2002).

Wagner, K. R., et al., "Loss of Myostatin Attenuates Severity of Muscular Dystrophy in mdx Mice," *Ann. Neurol.*; 52: 832-836 (2002).

Reichert, J. M., et al., "Monoclonal antibody successes in the clinic," *Nature Biotechnology*; 23(9): 1073-1078 (Sep. 2005).

Pavlou, A. K., et al., "The therapeutic antibodies market to 2008," *European Journal of Pharmaceutics and Biopharmaceutics*; 59: 389-396 (2005).

Clark, M. R., "IgG Effector Mechanisms," *Chem. Immunol.*; 65: 88-110 (1997).

Jefferis, R., et al., "Interaction sites on human IgG-Fc for FcγR: current models," *Immunology Letters*; 82: 57-65 (2002).

Smith, K. G. C., et al., "FcγRIIb in autoimmunity and infection: evolutionary and therapeutic implications," *Nature*; 10: 328-343 (May 2010).

Radeav, S., et al., "Recognition of IgG by Fcγ Receptor," *The Journal of Biological Chemistry*; 276(19): 16478-16483 (May 11, 2001).

Greenwood, J., et al., "Structural motifs involved in human IgG antibody functions," *Eur. J. Immunol.*; 23: 1098-1104 (1993).

Morgan, A., et al., "The N-terminal end of the $C_H2$ domain of chimeric human IgG1 anti-HLA-DR is necessary for C1q, FcγRI and FcγRIII binding," *Immunology*; 86: 319-324 (1995).

Nimmerjahn, F., et al., "Fcγ receptors as regulators of immune responses," *Nature*; 8: 34-47 (Jan. 2008).

Amigorena, S., et al., "FcγRII expression in resting and activated B lymphocytes," *Eur. J. Immunol.*; 19: 1379-1385 (1989).

Sinclair, N., "Regulation of the Immune Response," *J. Exp. Med.*; 129(6): 1183-1201 (Jun. 1, 1969).

Heyman, B., "Feedback regulation by IgG antibodies," *Immunology Letters*; 88: 157-161 (2003).

Amigorena, S., et al., "Cytoplasmic Domain Heterogeneity and Functions of IgG Fc Receptors in B Lymphocytes," *Science*; 256: 1808-1812 (Jun. 26, 1992).

Muta, T., et al., A 13-amino-acid motif in the cytoplasmic domain of FcγRIIB modulates B-cell receptor signalling; *Nature*; 368: 70-73 (Mar. 3, 1994).

Ravetch, J. V., et al., "Immune Inhibitory Receptors," *Science*; 290: 84-89 (Oct. 6, 2000).

Fournier, E. M., et al., "Activation of Human Peripheral IgM B Cells Is Transiently Inhibited by BCR-Independent Aggregation of FcγRIIB," *The Journal of Immunology*; 181: 5350-5359 (2008).

Wernersson, S., et al., "IgG-Mediated Enhancement of Antibody Responses Is Low in Fc Receptor γ Chain-Deficient Mice and Increased in FcγRII-Deficient Mice," *The Journal of Immunolgy*; 163: 618-622 (1999).

Yuasa, T., et al., "Deletion of Fcγ Receptor IIB Renders H-$2^b$ Mice Susceptible to Collagen-induced Arthritis," *J. Exp. Med.*; 189(1): 187-194 (Jan. 4, 1999).

Nakamura, A., et al., "Fcγ Receptor IIB-deficient Mice Develop Goodpasture's Syndrome upon Immunization with Type IV Collagen: A Novel Murine Model for Autoimmune Glomerular Basement Membrane Disease," *J. Exp. Med.*; 191(5): 899-905 (Mar. 6, 2000).

Blank, M. C., et al., "Decreased transcription of the human FCGR2B gene mediated by the -343 G/C promoter polymorphism and association with systemic lupus erythematosus," *Hum. Genet.*; 117: 220-227 (2005).

Olferiev, M., et al., "The Role of Activating Protein 1 in the Transcriptional Regulation of the Human FCGR2B Promoter Mediated by the -343 G→C Polymorphism Associated with Systemic Lupus Erythematosus," *The Journal of Biological Chemistry*; 282(3): 1738-1746 (Jan. 19, 2007).

Chen, J.-Y., et al., "Association of a Transmembrane Polymorphism of Fcγ Receptor IIb (FCGR2B) with Systemic Lupus Erythematosus in Taiwanese Patients," *Arthritis & Rheumatism*; 54(12): 3908-3917 (Dec. 2006).

(56) References Cited

OTHER PUBLICATIONS

Floto, R. A., et al., "Loss of function of a lupus-associated FcγRIIb polymorphism through exclusion from lipid rafts," *Nature Medicine*; 11(10): 1056-1058 (Oct. 2005).
Li, D. H., et al., "CD72 Down-Modulates BCR-Induced Signal Transduction and Diminishes Survival in Primary Mature B Lymphocytes," *The Journal of Immunology*; 176: 5321-5328 (2006).
Mackay, M., et al., "Selective dysregulation of the FcγIIB receptor on memory B cells in SLE," *J. Exp. Med.*; 203(9): 2157-2164 (Oct. 2006).
Su, K.., et al., "Expression Profile of FcγRIIB on Leukocytes and Its Dysregulation in Systemic Lupus Erythematosus," *The Journal of Immunology*; 178: 3272-3280 (2007).
Bruhns, P., et al., "Specificity and affinity of human Fcγ receptors and their polymorphic variants for human IgG subclasses," *Blood*; 113(16): 3716-3725 (Apr. 16, 2009).
Chu, S. Y., et al., "Inhibition of B cell receptor-mediated activation of primary human B cells by coengagement of CD19 and FcγRIIb with Fc-engineered antibodies," *Molecular Immunology*; 45: 3926-3933 (2008).
Chu, S. Y., et al., "Reduction of total IgE by targeted coengagement of IgE B-cell receptor and FcγRIIb with Fc-engineered antibody," *J. Allergy Clin. Immunol.*: 129(4): 1102-1115 (Apr. 2012).
Veri, M.-C., et al., "Therapeutic Control of B Cell Activation via Recruitment of Fcγ Receptor IIb (CD32B) Inhibitory Function With a Novel Bispecific Antibody Scaffold," *Arthritis & Rheumatism*; 62(7): 1933-1943 (Jul. 2010).
Cemerski, S., et al., "Suppression of mast cell degranulation through a dual-targeting tandem IgE-IgG Fc domain biologic engineered to bind with high affinity to FcγRIIb," *Immunology Letters*; 143: 34-43 (2012).
Wenink, M. H., et al., "The Inhibitory FcγIIb Receptor Dampens TLR4-Mediated Immune Responses and is Selectively Up-regulated on Dendritic Cells from Rheumatoid Arthritis Patients with Quiescent Disease," *The Journal of Immunology*; 183: 4509-4520 (2009).
Zhang, Y., et al., "Immune Complex/Ig Negatively Regulate TLR4-Triggered Inflammatory Response in Macrophages through FcγRIIb-Dependent $PGE_2$ Production," *The Journal of Immunology*; 182: 554-562 (2009).
Li, F., et al., "Inhibitory Fcγ Receptor Engagement Drives Adjuvant and Anti-Tumor Activities of Agonistic CD40 Antibodies," *Science*; 333: 1030-1034 (Aug. 19, 2011).
Wilson, N. S., et al., "An Fcγ Receptor-Dependent Mechanism Drives Antibody-Mediated Target-Receptor Signaling in Cancer Cells," *Cancer Cell*; 19: 101-113 (Jan. 18, 2011).
Kohrt, H. E., et al., "Stimulation of natural killer cells with a CD137-specific antibody enhances trastuzumab efficacy in xenotransplant models of breast cancer," *The Journal of Clinical Investigation*; 122(3): 1066-1075 (Mar. 2012).
Xu, Y., et al., "FcγRs Modulate Cytotoxicity of Anti-Fas Antibodies: Implications for Agonistic Antibody-Based Therapeutics," *The Journal of Immunology*; 171: 562-568 (2003).
Zhang, M., et al., "Effective therapy for a murine model of human anaplastic large-cell lymphoma with the anti-CD30 monoclonal antibody, HeFi-1, does not require activating Fc receptors," *Blood*; 108(2): 705-710 (Jul. 15, 2006).
Chuntharapai, A., et al., "Isotype-Dependent Inhibition of Tumor Growth In Vivo by Monoclonal Antibodies to Death Receptor 4," *The Journal of Immunology*; 166: 4891-4898 (2001).
Li, F., et al., "Apoptotic and antihumor activity of death receptor antibodies require inhibitory Fcγ receptor engagement," *PNAS*; 109(27): 10966-10971 (Jul. 3, 2012).
Scappaticci, F. A., et al., "Arterial Tromboembolic Events in Patients with Metastatic Carcinoma Treated with Chemotherapy and Bevacizumab," *JNCI*; 99(16): 1232-1239 (Aug. 15, 2007).
Boumpas, D. T., et al., "A Short Course of BG9588 (Anti-CD40 Ligand Antibody) Improves Serologic Activity and Decreases Hematuria in Patients with Proliferative Lupus Glomerulonephritis," *Arthritis & Rheumatism*; 48(3): 719-727 (Mar. 2003).
Meyer, T., et al., "Bevacizumab immune complexes activate platelets and induce thrombosis in FCGR2A transgenic mice," *J. Thromb. Haemost.*; 7: 171-181 (2009).
Robles-Carrillo, L., et al., "Anti-CD40L Immune Complexes Potently Activate Platelets In Vitro and Cause Thrombosis in FCGR2A Transgenic Mice," *The Journal of Immunology*; 185: 1577-1583 (2010).
Duffau, P., et al., "Platelet CD154 Potentiates Interferon-α Secretion by Plasmacytoid Dendritic Cells in Systemic Lupus Erythematosus," *Science Translational Medicine*; 2(47): 47ra63 (Sep. 1, 2010).
Richards, J. O., et al., "Optimization of antibody binding to FcγRIIa enhances macrophage phagocytosis of tumor cells," *Mol. Cancer Ther.*; 7(8): 2517-2527 (Aug. 2008).
Desai, D. D., et al., "Fcγ Receptor IIB on Dendritic Cells Enforces Peripheral Tolerance by Inhibiting Effector T Cell Responses," *The Journal of Immunology*; 178: 6217-6226 (2007).
Salmon, J. E., et al., "FcγRIIA Alleles are Heritable Risk Factors for Lupus Nephritis in African Americans," *The Journal of Clinical Investigation*; 97(5): 1348-1354 (Mar. 1996).
Manger, K., et al., "Fcγ Receptor IIa Polymorphism in Caucasian Patients with Systemic Lupus Erythematosus," *Arthritis & Rheumatism*; 41(7): 1181-1189 (Jul. 1998).
Boruchov, A. M., et al., "Activating and inhibitory IgG Fc receptors on human DCs mediate opposing functions," *The Journal of Clinical Investigation*; 115(10): 2914-2923 (Oct. 2005).
Dhodapkar, K. M., et al., "Selective blockade of inhibitory Fcγ receptor enables human dendritic cell maturation with IL-12p70 production and immunity to antibody-coated tumor cells," *PNAS*; 102(8): 2910-2915 (Feb. 22, 2005).
Armour, K. L., et al., "Differential binding to human FcγRIIa and FcγRIIb receptors by human IgG wildtype and mutant antibodies," *Molecular Immunology*; 40: 585-593 (2003).
Warmerdam, P. A. M., et al., "Molecular Basis for a Polymorphism of Human Fcγ Receptor II (CD32)," *J. Exp. Med.* 172: 19-25 (Jul. 1990).
Mimoto, F., et al., "Engineered antibody Fc variant with selectively enhanced Fc γRIIb binding over both Fc γRIIaR$^{131}$ and Fc γRIIa$^{H131}$," *Protein Engineering, Design & Selection*; 26(10): 589-598 (2013).
Moore, G. L., et al., "Engineered Fc variant antibodies with enhanced ability to recruit complements and mediate effector functions," mAbs; 2(2): 181-189 (Mar./Apr. 2010).
Office Action dated Jul. 27, 2016 for commonly-owned U.S. Appl. No. 12/295,039.
Onda, M., et al., "Lowering the Isoelectric Point of the Fv Portion of Recombinant Immunotoxins Leads to Decreased Nonspecific Animal Toxicity without Affecting Antitumor Activity," *Cancer Research*; 61: 5070-5077 (Jul. 1, 2001).
Notice of Allowance dated Aug. 9, 2016 for commonly-owned U.S. Appl. No. 13/889,512.
Schröter, C., et al., "A generic approach to engineer antibody pH-switches using combinatorial histidine scanning libraries and yeast display," mAbs; 7(1): 138-151 (Jan./Feb. 2015).
Wu, S.-J., et al., "Structure-based engineering of a monoclonal antibody for improved solubility," *Protein Engineering, Design & Selection*; 23(8): 643-651 (2010).
Kim, S. J., et al., "Antibody Engineering for the Development of Therapeutic Antibodies," *Mol. Cells*; 20(1): 17-29 (2005).
Hinton, P. R., et al., "An Engineered Human IgG1 Antibody with Longer Serum Half-Life," *The Journal of Immunology*; 176: 346-356 (2006).
Ghetie, V., et al., "Increasing the serum persistence of an IgG fragment by random mutagenesis," *Nature Biotechnology*; 15: 637-640 (Jul. 1997).
Rajpal, A., et al., "A general method for greatly improving the affinity of antibodies by using combinatorial libraries," *PNAS*; 102(24): 8466-8471 (Jun. 14, 2005).

(56) References Cited

OTHER PUBLICATIONS

Wu, H., et al., "Development of Motavizumab, an Ultra-potent Antibody for the Prevention of Respiratory Syncytial Virus Infection in the Upper and Lower Respiratory Tract," *J. Mol. Biol.*; 368: 652-665 (2007).
Igawa, T., et al., "Antibody recycling by engineered pH-dependent antigen binding improves the duration of antigen neutralization," *Nature Biotechnology*; 28(11): 1203-1207 (Nov. 2010).
Dall'Acqua, W. F., et al., "Properties of Human IgG1s Engineered for Enhanced Binding to the Neonatal Fc Receptor (FcRn)," *The Journal of Biological Chemistry*; 281(33): 23514-23524 (Aug. 18, 2006).
Zalevsky, J., et al., "Enhanced antibody half-life improves in vivo activity," *Nature Biotechnology*; 28(2): 157-159 (Feb. 2010).
Zheng, Y., et al., "Translational Pharmacokinetics and Pharmacodynamics of an FcRn-Variant Anti-CD4 Monoclonal Antibody From Preclinical Model to Phase I Study," *Clinical Pharmacology & Therapeutics*; 89(2): 283-290 (Feb. 2011).
Lazar, G. A., et al., "Engineered antibody Fc variants with enhanced effector function," *PNAS*; 103(11): 4005-4010 (Mar. 14, 2006).
Shinkawa, T., et al., "The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity," *The Journal of Biological Chemistry*; 278(5): 3466-3473 (Jan. 31, 2003).
Clynes, R., et al., "Fc receptors are required in passive and active immunity to melanoma," *Proc. Natl. Acad. Sci.*; 95: 652-656 (Jan. 1998).
Clynes, R. A., et al., "Inhibitory Fc receptors modulate in vivo cytoxicity against tumor targets," *Nature Medicine*; 6(4): 443-446 (Apr. 2000).
Holash, J., et al., "VEGF-Trap: A VEGF blocker with potent antitumor effects," *PNAS*; 99(17): 11393-11398 (Aug. 20, 2002).
Russo, R. C., et al., "The CXCL8/IL-8 chemokine family and its receptors in inflammatory diseases," *Expert Rev. Clin. Immunol.*; 10(5): 593-619 (2014).
De Groot, A. S., et al., "Reducing risk, improving outcomes: Bioengineering less immunogenic protein therapeutics," *Clinical Immunology*; 131: 189-201 (2009).
International Search Report, dated Mar. 15, 2016, issued in connection with corresponding International Application No. PCT/JP2015/006323.
Adams, C.W., et al., "Humanization of a Recombinant Monoclonal Antibody to Produce a Therapeutic Her Dimerization Inhibitor, Pertuzumab," Cancer Immunology, Immunotherapy 55(6):717-727, Springer International, Germany (2006).
Algonomics—TripoleR applications [Online] Retrieved from the Internet on Feb. 29, 2012, http://www.algonomics.com/proteinengineering/tripole_plications.php, 2 pages (Feb. 21, 2009).
Almagro, J.C. and Fransson, J., "Humanization of Antibodies," Frontiers in Bioscience 13:1619-1633, Frontiers in Bioscience Publications, United States (2008).
Amersham Biosciences: Affinity Chromatography: Principles and Methods, 2002:16-8,137.
Amersham Biosciences. Antibody Purification Handbook, Edition 18-1037-46.
"Antibody Structure and Function," in Immunology, 5th edition, Roitt, I., et al., eds., pp. 80-81.
Armour, K.L., et al., "Recombinant Human IgG Molecules Lacking Fc? Receptor I Binding and Monocyte Triggering Activities," European Journal of Immunology 29(8):2613-2624, Wiley-VCH, Germany (1999).
Balint, R.F. and Larrick, J.W., "Antibody Engineering by Parsimonious Mutagenesis," Gene 137(1):109-118, Elsevier/North-Holland, Netherlands (1993).
Bartelds, G.M., et al., "Clinical Response to Adalimumab: Relationship to Anti-adalimumab Antibodies and Serum Adalimumab Concentrations in Rheumatoid Arthritis," Annals of the Rheumatic Diseases 66(7):921-926, BMJ, England (2007).

Batra, S.K., et al., "Pharmacokinetics and Biodistribution of Genetically Engineered Antibodies," Current Opinion in Biotechnology 13(6):603-608, Current Biology, England (2002).
Bayry, J., et al., "Immuno Affinity Purification of Foot and Mouth Disease Virus Type Specific Antibodies Using Recombinant Protein Adsorbed to Polystyrene ," Journal of Virological Methods 81(1-2):21-30, North-Holland Biomedical Press, Netherlands (1999).
Beck, A., et al., "Strategies and Challenges for the Next Generation of Therapeutic Antibodies," Nature Reviews. Immunology 10(5):345-352, Nature Publishing Group, England (2010).
Bender, N.K., et al., "Immunogenicity, Efficacy and Adverse Events of Adalimumab in RA Patients," Rheumatology International 27(3):269-274, Springer International, Germany (2007).
Binz, H.K., et al., "Engineering Novel Binding Proteins from Nonimmunoglobulin Domains," Nature Biotechnology 23(10):1257-1268, Nature America Publishing, United States (2005).
Brown, M., et al., "Tolerance to Single, but Not Multiple, Amino Acid Replacements in AntibodyVH CDR2: A Means of Minimizing B Cell Wastage from Somatic Hypermutation?," Journal of Immunology 156(9):3285-3291, American Association of Immunologists, United States (1996).
Brown, N.L., "A Study of the Interactions between an IgG-Binding Domain Based on the B Domain of Staphylococcal Protein A and Rabbit IgG," Molecular Biotechnology 10(1):9-16, Humana Press, Totowa, New Jersey (1998).
Bruhns, P., "Properties of Mouse and Human IgG Receptors and Their Contribution to Disease Models," Blood 19(24):5640-5649, American Society of Hematology, United States (2012).
Burmeister, W.P., et al., "Crystal Structure of the Complex of Rat Neonatal Fc Receptor with Fc," Nature 372(6504):379-383, Nature Publishing Group, England (1994).
Cartron, G., et al., "Therapeutic Activity of Humanized Anti-cd20 Monoclonal Antibody and Polymorphism in IgG Fc Receptor FcgammaRIIIa Gene," Blood 99(3):754-758, American Society of Hematology, United States (2002).
Chaparro-Riggers, J., et al., "Increasing Serum Half-life and Extending Cholesterol Lowering in Vivo by Engineering Antibody With pH-sensitive Binding to PCSK9," The Journal of Biological Chemistry 287(14):11090-11097, American Society for Biochemistry and Molecular Biology, United States (2012).
Chau, L.A., et al., "HuM291(Nuvion), a Humanized Fc Receptor-Nonbinding Antibody Against CD3, Anergizes Peripheral Blood T Cells as Partial Agonist of the T Cell Receptor," Transplantation 71(7):941-950, Lippincott Williams & Wilkins, United States (2001).
Chen, C., et al., "Defective Secretion of an Immunoglobulin Caused by Mutations in the Heavy Chain Complementarity Determining Region 2," The Journal of Experimental Medicine 180(2):577-586, Rockefeller University Press, United States (1994).
Chen, C., et al., "Generation and Analysis of Random Point Mutations in an Antibody CDR2 Sequence: Many Mutated Antibodies Lose Their Ability to Bind Antigen," The Journal of Experimental Medicine 176(3):855-866, Rockefeller University Press, United States (1992).
Chen, Y., et al., "Selection and Analysis of an Optimized Anti-VEGF Antibody: Crystal Structure of an Affinity-matured Fab in Complex with Antigen," Journal of Molecular Biology 293(4):865-881, Academic Press, England (1999).
Chirino, A.J., et al., "Minimizing the Immunogenicity of Protein therapeutics," Drug Discovery Today 9(2):82-90, Elsevier Science Ltd., England (2004).
Chu, G.C., et al., "Accumulation of Succinimide in a Recombinant Monoclonal Antibody in Mildly Acidic Buffers Under Elevated Temperatures," Pharmaceutical Research 24(6):1145-1156, Kluwer Academic, United States (2007).
Cole, M.S., et al., "Human IgG2 Variants of Chimeric Anti-CD3 are Nonmitogenic to T Cells," Journal of Immunology 159(7):3613-3621, American Association of Immunologists, United States (1997).
Comper, W.D. and Glasgow, E.F., "Charge Selectivity in Kidney Ultrafiltration," Kidney International 47(5):1242-1251, Elsevier, England (1995).

(56) References Cited

OTHER PUBLICATIONS

Cordoba, A.J., et al., "Non-Enzymatic Hinge Region Fragmentation of Antibodies in Solution," Journal of Chromatography. B, Analytical Technologies in the Biomedical and Life Sciences 818(2):115-121, Elsevier, Netherlands (2005).

Couto, J.R., et al., "Anti-BA46 Monoclonal Antibody Mc3: Humanization Using a Novel Positional Consensus and In Vivo and In Vitro Characterization," Cancer Research 55(8):1717-1722, American Association for Cancer Research, United States (1995).

Cuatrecasas, P., and Anfinsen, C.B., "Affinity Chromatography," Methods in Enzymology 12:345-378 (1971).

Dall Acqua, W.F., et al., "Increasing the Affinity of a Human IgG1 for the Neonatal Fc Receptor: Biological Consequences," The Journal of Immunology 169(9):5171-5180, American Association of Immunologists, United States (2002).

Dall'Acqua, W.F., et al., "Antibody Humanization by Framework Shuffling," Methods 36(1):43-60, Academic Press, United States (2005).

Damschroder, M.M., et al., "Framework Shuffling of Antibodies to Reduce Immunogenicity and Manipulate Functional and Biophysical Properties," Molecular Immunology 44(11):3049-3060, Pergamon Press, England (2007).

Datta-Mannan, A., et al., "Monoclonal Antibody Clearance. Impact of Modulating the Interaction of IgG With the Neonatal Fc Receptor," The Journal of Biological Chemistry 282(3):1709-1717, American Society for Biochemistry and Molecular Biology, United States (2003).

De Groot, A.S., et al., "De-immunization of Therapeutic Proteins by T-cell Epitope Modification," Developments in Biologicals 122:171-194, Karger, Switzerland (2005).

Declaration of Dr. Nimish Gera, submitted in Opposition of EP Patent No. 2 275 443, filed Sep. 1, 2016, 24 pages.

Deen, W.M., et al., "Structural Determinants of Glomerular Permeability," American Journal of Physiology 281(4):F579-F596, American Physiological Society, United States (2001).

Del Rio, G., et al., "An Engineered Penicillin Acylase With Altered Surface Charge Is More Stable in Alkaline pH," Annals of the New York Academy of Sciences 799:61-64, Blackwell, United States (1996).

Devanaboyina, S.C., et al., "The Effect of pH Dependence of Antibody-antigen Interactions on Subcellular Trafficking Dynamics," mAbs 5(6):851-859, Taylor & Francis, United States. (2013).

Drake, A.W., and Papalin, G.A., "Biophysical Considerations for Development of Antibody-Based Therpeutics," 2012, Chapter 5, 95-97.

Durkee. K.H., et al., "Immunoaffinity Chromatographic Purification of Russell's Viper Venom Factor X Activator Using Elution in High Concentrations of Magnesium Chloride," Protein Expression and Purification 4(5):405-411, Academic Press, United States (1993).

Ejima D., et al., "Effective Elution of Antibodies by Arginine and Arginine Derivatives in Affinity Column Chromatography," Analytical biochemistry 345(2):250-257, Academic Press, United States (2005).

Ewert S., et al., "Stability Improvement of Antibodies for Extracellular and intracellular Applications: Cdr Grafting to Stable Frameworks and Structure-Based Framework Engineering," Molecular and cellular biology 34(2):184-199, Academic Press, United States (2004).

Feinberg, H., et al., "Mechanism of pH-dependent N-acetylgalactosamine Binding by a Functional Mimic of the Hepatocyte Asialoglycoprotein Receptor," The Journal of Biological Chemistry 275(45):35176-35184, American Society for Biochemistry and Molecular Biology, United States (2000).

Finkelman, F.D., et al., "Anti-cytokine Antibodies as Carrier Proteins. Prolongation of in Vivo Effects of Exogenous Cytokines by Injection of Cytokine-anti-cytokine Antibody Complexes," Journal of Immunology 151(3):1235-1244, American Association of Immunologists, United States (1993).

Fujii, I., et al., "Antibody Affinity Maturation by Random Mutagenesis," Methods in Molecular Biology 248:345-359, Humana Press, United States (2004).

GE Healthcare. Application note 28-9277-92 AA. "Highthroughput screening of elution pH for monoclonal antibodies on MabSelect SuRe using PreDictor plates".

Gerstner, R.B., et al., "Sequence Plasticity in the Antigen-binding Site of a Therapeutic Anti-HER2 Antibody," Journal of Molecular Biology 321(5):851-862, Elsevier, England (2002).

Gessner, J.E., et al., "The IgG Fc Receptor Family," Annals of Hematology 76(6):231-248, Springer International, Germany (1998).

Ghetie, V. and Ward, E.S., "FcRn: the MHC Class I-Related Receptor that is More Than an IgG Transporter," Immunology Today 18(12):592-598, Elsevier Science Publishers, England (1997).

Ghetie, V., et al., "Multiple Roles for the Major Histocompatibility Complex Class I-Related Receptor FcRn," Annual Review of Immunology 18:739-766, Annual Review, United States (2000).

Gobburu, J.V., et al., "Pharmacokinetics/Dynamics of 5c8, a Monoclonal Antibody to CD154 (CD40 Ligand) Suppression of an Immune Response in Monkeys," Journal of Pharmacology and Experimental Therapeutics 286(2):925-930, American Society for Pharmacology and Experimental Therapeutics, United States (1998).

Goode, N.P., et al., "The Glomerular Basement Membrane Charge-selectivity Barrier: an Oversimplified Concept?," Nephrology, Dialysis, Transplantation 11(9):1714-1716, Springer International, England (1996).

Graves, S.S., et al., "Molecular Modeling and Preclinical Evaluation of the Humanized NR-LU-13 Antibody," Clinical Cancer Research 5(4):899-908, The Association, United States (1999).

Guyre, PM et al., "Increased potency of Fc-receptor-targeted antigens," Cancer Immunology, Immunotherapy 45(3-4):146-148, Springer International, Germany (1997).

Hanson, C.V., et al., "Catalytic Antibodies and their Applications," Current Opinion in Biotechnology 16(6):631-636, Elsevier, England (2005).

He, X.Y., et al., "Humanization and Pharmacokinetics of a Monoclonal Antibody with Specificity for both E- and P-Selectin," Journal of Immunology 160(2):1029-1035, American Association of Immunologists, United States (1998).

Hinton, P.R., et al., "Engineered Human IgG Antibodies With Longer Serum Half-lives in Primates," The Journal of Biological Chemistry 279(8):6213-6216, American Society for Biochemistry and Molecular Biology, United States (2004).

Hjelm, F., et al., "Antibody-mediated Regulation of the Immune Response," Scandinavian Journal of Immunology 64(3):177-184, Blackwell Scientific, England (2006).

Horton, H.M., et al., "Potent in Vitro and in Vivo Activity of an Fc-engineered Anti-CD19 Monoclonal Antibody Against Lymphoma and Leukemia," Cancer Research 68(19):8049-8057, American Association for Cancer Research, United States (2008).

Hwang, W.Y., et al., "Use of Human Germline Genes in a CDR Homology-Based Approach to Antibody Humanization," Methods 36(1):35-42, Academic Press, United States (2005).

Idusogie, E.E., et al., "Mapping of the C1q Binding Site on Rituxan, A Chimeric Antibody with a Human IgG1 Fc," The Journal of Immunology 164(8):4178-4184, American Association of Immunologists, United States (2000).

Igawa, "Antibody Optimization Technologies for Developing Next Generation Antibody Therapeutics," Bioindustry 28(7):15-21 (2011).

Igawa, T., et al., "Engineered Monoclonal Antibody With Novel Antigen-Sweeping Activity in Vivo," PloS One 8(5):e63236, Public Library of Science, United States (2013).

Igawa, T., et al., "Engineering the Variable Region of Therapeutic IgG Antibodies," mAbs 3(3):243-252, Taylor & Francis, United States. (2011).

Igawa, T., et al., "Reduced Elimination of IgG Antibodies by Engineering the Variable Region," Protein Engineering, Design & Selection 23(5):385-392, Oxford University Press, England (2010).

(56) References Cited

OTHER PUBLICATIONS

Ishii-Watabe, A., et al., "FcRn, a Critical Regulator of Antibody Pharmacokinetics," Nihon Yakurigaku Zasshi 136(5):280-284, Nippon Yakuri Gakkai, (2010).
Ito, W., et al., "The His-probe Method: Effects of Histidine Residues Introduced Into the Complementarity-determining Regions of Antibodies on Antigen-antibody Interactions at Different pH Values," FEBS Letters 309(1):85-88, John Wiley & Sons, England (1992).
Johnson, K.A., et al., "Cation Exchange-HPLC and Mass Spectrometry Reveal C-Terminal Amidation of an IgG1 Heavy Chain," Analytical Biochemistry 360(1):75-83, Academic Press, United States (2007).
Jones, T.D., et al., "Identification and Removal of a Promiscuous CD4+ T Cell Epitope from the C1 Domain of Factor VIII," Journal of Thrombosis and Haemostasis 3(5):991-1000, Blackwell Pub, England (2005).
Junghans, R.P. and Anderson, C.L., "The Protection Receptor for IgG Catabolism Is the Beta2-microglobulin-containing Neonatal Intestinal Transport Receptor," Proceedings of the National Academy of Sciences of the USA 93(11):5512-5516, National Academy of Sciences, United States (1996).
Kashmiri, S.V., et al., "Generation, Characterization, and In Vivo Studies of Humanized Anticarcinoma Antibody CC49," Hybridoma 14(5):461-473, Mary Ann Liebert, United States (1995).
Katayose, Y., et al., "MUC1-Specific Targeting Immunotherapy with Bispecific Antibodies: Inhibition of Xenografted Human Bile Duct Carcinoma Growth," Cancer Research 56(18):4205-4212, American Association for Cancer Research, United States (1996).
Khawli, L.A., et al., "Improved Tumor Localization and Radioimaging with Chemically Modified Monoclonal Antibodies," Cancer Biotherapy and Radiopharmaceuticals 11(3):203-215, Liebert, United States (1996).
Kim, I., et al., "Lowering of pI by Acylation Improves the Renal Uptake of 99mTc-Labeled anti-Tac dsFv: Effect of Different Acylating Reagents," Nuclear Medicine and Biology 29(8):795-801, Elsevier, United States (2002).
Kim, I.S., et al., "Chemical Modification to Reduce Renal Uptake of Disulfide-bonded Variable Region Fragment of Anti-tac Monoclonal Antibody Labeled With 99mTc," Bioconjugate Chemistry 10(3):447-453, American Chemical Society, United States (1999).
Kobayashi, H., et al., "The Pharmacokinetic Characteristics of Glycolated Humanized Anti-tac Fabs are Determined by their Isoelectric Points," Cancer Research 59(2):422-430, American Association for Cancer Research, United States (1999).
Kobayashi, T., et al., "A Monoclonal Antibody Specific for a Distinct Region of Hen Egg-white Lysozyme," Molecular Immunology 19(4):619-630, Pergamon Press, England (1982).
Komissarov, A.A., et al., "Site-specific Mutagenesis of a Recombinant Anti-single-stranded DNA Fab. Role of Heavy Chain Complementarity-determining Region 3 Residues in Antigen Interaction," 272(43):26864-26870, American Society for Biochemistry and Molecular Biology, United States (1997).
Laitinen, O.H., et al., "Brave New (Strept)Avidins in Biotechnology," Trends in Biotechnology 25(6):269-277, Elsevier Science, England (2007).
Lee, C.V., et al., "High-affinity Human Antibodies From Phage-displayed Synthetic Fab Libraries With a Single Framework Scaffold," Journal of Molecular Biology 340(5):1073-1093, Academic Press, England (2004).
Leong, S.R., et, al., "Adapting Pharmacokinetic Properties of a Humanized Anti-Interleukin-8 Antibody for Therapeutic Applications Using Site-Specific Pegylation," Cytokine 16(3):106-119, Elsevier Science Ltd., England (2001).
Lin, Y.S., et al., "Preclinical Pharmacokinetics, Interspecies Scaling, and Tissue Distribution of a Humanized Monoclonal Antibody Against Vascular Endothelial Growth Factor," The Journal of Pharmacology and Experimental Therapeutics 288(1):371-378, American Society for Pharmacology and Experimental Therapeutics, United States (1999).

Linder, M., et al., "Design of a pH-Dependent Cellulose-Binding Domain," FEBS Letters 447(1):13-16, North-Holland on behalf of the Federation of European Biochemical Societies, Amsterdam (1999).
Liu, H., et al., "Heterogeneity of Monoclonal Antibodies," Journal of Pharmaceutical Sciences 97(7):2426-2447, Wiley-Liss, United States (2008).
Lobo, E.D., et al., "Antibody Pharmacokinetics and Pharmacodynamics," Journal of Pharmaceutical Sciences 93(11):2645-2668, Wiley-Liss, United States (2004).
Lund, J., et al., "Multiple Binding Sites on the CH2 Domain of IgG for Mouse Fc Gamma R," Molecular Immunology 29(1):53-59, Pergamon Press, England (1992).
MacCallum, R.M., et al., "Antibody-Antigen Interactions: Contact Analysis and Binding Site Topography," Journal of Molecular Biology 262(5):732-745, Elsevier, England (1996).
Maeda, K., et al., "pH-Dependent Receptor/ligand Dissociation as a Determining Factor for Intracellular Sorting of Ligands for Epidermal Growth Factor Receptors in Rat Hepatocytes," Journal of Controlled Release 82(1):71-82, Elsevier Science, Netherlands (2002).
Maini, R.N., et al, "Double-blind Randomized Controlled Clinical Trial of the Interleukin-6 Receptor Antagonist, Tocilizumab, in European Patients With Rheumatoid Arthritis Who Had an Incomplete Response to Methotrexate," 54(9):2817-2829, Wiley-Blackwell, United States (2006).
Marshall, S.A., et al., "Rational Design and Engineering of Therapeutic Proteins," Drug Discovery Today 8(5):212-221, Elsevier Science Ltd, Irvington, New Jersey (2003).
Martin, W.L., et al., "Crystal Structure at 2.8 A of an FcRn/Heterodimeric Fc Complex: Mechanism of pH-Dependent Binding," Molecular Cell 7(4):867-877, Cell Press, United States (2001).
Matsumiya, S., et al., "Structural Comparison of Fucosylated and Nonfucosylated Fc Fragments of Human Immunoglobulin G1," Journal of Molecular Biology368(3):767-779,Elsevier, England (2007).
Maxfield, F.R. and McGraw, T.E., "Endocytic Recycling," Nature Reviews 5(2):121-132, Nature Publishing Group, England (2004).
Mi, W., et al., "Targeting the Neonatal Fc Receptor for Antigen Delivery using Engineered Fc Fragments," Journal of Immunology 181(11):7550-7561, American Association of Immunologists, United States (2008).
Mohan, et al Calbiochem Buffers, "A guide for the preparation and use of buffers in biological systems," by chandra Mohan, Ph.D. ,Copyright 2003 EMD Biosciences, Inc.,an Affliate of Merck K GaA, Darmastadt, Germany ,37pages (CALBIOCHEM Buffers Booklet, 2003).
Montero-Julian, F.A., et al., "Pharmacokinetic Study of Anti-interleukin-6 (IL-6) Therapy With Monoclonal Antibodies: Enhancement of IL-6 Clearance by Cocktails of Anti-il-6 Antibodies," Blood 85(4):917-924, American Society of Hematology, United States (1995).
Murtaugh, M.L., et al., "A Combinatorial Histidine Scanning Library Approach to Engineer Highly pH-dependent Protein Switches," Protein Science 20(9):1619-1631, Cold Spring Harbor Laboratory Press, United States (2011).
Nesterova, A., et al., "Glypican-3 as a novel target for an antibody-drug conjugate," AACR Annual Meeting Apr. 14-18, 2007, Abstract No. 656, (2007).
Nimmerjahn, F. and Ravetch, J.V., "Divergent Immunoglobulin G Subclass Activity Through Selective Fc Receptor Binding," Science 310(5753):1510-1512, American Association for the Advancement of Science, United States (2005).
Nishimoto, N. and Kishimoto, T., "Interleukin 6: From Bench to Bedside," Nature Clinical Practice. Rheumatology 2(11):619-626, Nature Publishing Group, United States (2006).
Nishimoto, N., et al., "Humanized Anti-interleukin-6 Receptor Antibody Treatment of Multicentric Castleman Disease," Blood 106(8):2627-2632, American Society of Hematology, United States (2005).
Nordlund, H.R., et al., "Introduction of Histidine Residues Into Avidin Subunit Interfaces Allows pH-dependent Regulation of

(56) References Cited

OTHER PUBLICATIONS

Quaternary Structure and Biotin Binding," FEBS Letters 555(3):449-454, John Wiley & Sons Ltd, England (2003).
Ono, K., et al., "The Humanized Anti-HM1.24 Antibody Effectively Kills Multiple Myeloma Cells by Human Effector Cell-Mediated Cytotoxicity," Molecular Immunology 36(6):387-395, Pergamon Press, England (1999).
Ozhegov, et al, Tolkovyi Slovar Russkogo iazyka: 2004, p. 292.
Pakula, A.A. and Sauer, R.T., "Genetic Analysis of Protein Stability and Function," Annual Review of Genetics 23:289-310, Annual Reviews, United States (1989).
Palladino, M.A., et al, "Anti-TNF-Alpha Therapies: the Next Generation," Nature Reviews Drug Discovery 2(9):736-746, Nature Publishing Group, England (2003).
Pardridge, W.M., et al., "Enhanced Endocytosis in Cultured Human Breast Carcinoma Cells and In Vivo Biodistribution in Rats of a Humanized Monoclonal Antibody After Cationization of the Protein," Journal of Pharmacology and Experimental Therapeutics 286(1):548-554, American Society for Pharmacology and Experimental Therapeutics, United States (1998).
Pavlinkova, G., et al., "Charge-modified Single Chain Antibody Constructs of Monoclonal Antibody CC49: Generation, Characterization, Pharmacokinetics, and Biodistribution Analysis," Nuclear Medicine and Biology 26(1):27-34, Elsevier, United States (1999).
Poduslo, J. F. and Curran, G. L., "Polyamine Modification Increases the Permeability of Proteins at the Blood-Nerve and Blood-Brain Barriers," Journal of Neurochemistry 66(4):1599-1609, Blackwell Science, England (1996).
Pons, J., et al., "Energetic Analysis of an Antigen/Antibody Interface: Alanine Scanning Mutagenesis and Double Mutant Cycles on the HyHEL-10/lysozyme Interaction," 8(5):958-968, Cold Spring Harbor Laboratory Press, United States (1999).
Presta, L.G., "Engineering of Therapeutic Antibodies to Minimize Immunogenicity and Optimize Function," Advanced Drug Delivery Reviews 58(5-6):640-656, Elsevier Science, Netherlands (2006).
Rathanaswami, P., et al., "Demonstration of an in Vivo Generated Sub-picomolar Affinity Fully Human Monoclonal Antibody to Interleukin-8," Biochemical and Biophysical Research Communications 334(4):1004-1013, Elsevier, United States (2005).
Reddy M.P., et al., "Elimination of Fc Receptor-Dependent Effector Functions of a Modified IgG4 Monoclonal Antibody to Human CD4," Journal of Immunology 164(4):1925-1933, American Association of Immunologists, United States (2000).
Reichert, J.M. and Valge-Archer, V.E., "Development Trends for Monoclonal Antibody Cancer Therapeutics," Nature Reviews. Drug Discovery 6(5):349-356, Nature Pub. Group, London (2007).
Reverberi, R. and Reverberi, L., "Factors Affecting the Antigen-antibody Reaction," Blood Transfusion 5(4):227-240, SIMTI servizi, Italy (2007).
Rich, R.L. and Myska, D.G., "Grading the Commercial Optical Biosensor Literature—Class of 2008: 'The Mighty Binders'," Journal of Molecular Recognition 23(1):1-64, John Wiley & Sons, England (2010).
Roitt, et al Immunology, Moscow, "Mir", 2000, pp. 110 to 111.
Rojas, J.R., et al., "Formation, Distribution, and Elimination of Infliximab and Anti-infliximab Immune Complexes in Cynomolgus Monkeys," The Journal of Pharmacology and Experimental Therapeutics 313(2):578-585, American Society for Pharmacology and Experimental Therapeutics, United States (2005).
Roopenian, D.C. and Akilesh, S., "FcRn: the Neonatal Fc Receptor Comes of Age," Nature Reviews Immunology 7(9):715-725, Nature Publishing Group, England (2007).
Rothe, A., et al., "Ribosome Display for Improved Biotherapeutic Molecules," Expert Opinion on Biological Therapy 6(2):177-187, Taylor & Francis, England (2006).
Rudikoff, S., et al., "Single Amino Acid Substitution Altering Antigen-Binding Specificity," Proceedings of the National Academy of Sciences USA 79(6):1979-1983, The National Academy of Sciences, United States (1982).

Salfeld, J.G., "Isotype Selection in Antibody Engineering," Nature Biotechnology 25(12):1369-1372, Nature America Publishing, United States (2007).
Sarkar, C.A., et al., "Rational Cytokine Design for Increased Lifetime and Enhanced Potency Using pH-activated Histidine Switching," Nature Biotechnology 20(9):908-913, Nature America Publishing, United States (2002).
Sato, K., et al., "Reshaping a Human Antibody to Inhibit the Interleukin 6-Dependent Tumor Cell Growth," Cancer Research 53(4):851-856, American Association for Cancer Research, United States (1993).
Schaeffer, R.C. Jr., et al., "The Rat Glomerular Filtration Barrier Does Not Show Negative Charge Selectivity," Microcirculation 9(5):329-342, Wiley-Blackwell, United States (2002).
Schmitz, U., et al., "Phage Display: a Molecular Tool for the Generation of Antibodies—a Review," Placenta 21 Suppl A:S106-S112, Elsevier, Netherlands (2000).
Schroeder, H.W., Jr., "Similarity and Divergence in the Development and Expression of the Mouse and Human Antibody Repertoires," Developmental & Comparative Immunology 30(1-2):119-135, Elsevier Science, Tarrytown New York (2006).
Shields, R.L., et al., "High Resolution Mapping of the Binding Site on Human IgG1 for Fc Gamma RI, Fc Gamma RII, Fc Gamma RIII, and FcRn and Design of IgG1 Variants with Improved Binding to the Fc Gamma R," The Journal of Biological Chemistry 276(9):6591-6604, American Society for Biochemistry and Molecular Biology, United States (2001).
Shire, S.J., et al., "Challenges in the Development of High Protein Concentration Formulations," Journal of Pharmaceutical Sciences 93(6):1390-1402, Elsevier, United States (2004).
Siberil, S., et al., "Molecular Aspects of Human Fcgammar Interactions with IgG: Functional and Therapeutic Consequences," Immunology Letters 106(2):111-118, Elsevier/North-Holland Biomedical Press, Netherlands (2006).
Sigma-Aldrich®, Product Information, Monoclonal ANTI-FLAG® M1, Clone M1, accessed at http://www.sigmaaldrich.com/content/dam/sigmaaldrich/ does/Sigma/Datasheet/f3040dat.pdf, 1 page.
Stearns, D.J., et al., "The Interaction of a Ca2+-dependent Monoclonal Antibody With the Protein C Activation Peptide Region. Evidence for Obligatory Ca2+ Binding to Both Antigen and Antibody," The Journal of Biological Chemistry 263(2):826-832, American Society for Biochemistry and Molecular Biology, United States (1988).
Stewart, J.D., et al., "Site-directed Mutagenesis of a Catalytic Antibody: an Arginine and a Histidine Residue Play Key Roles," Biochemistry 33(8):1994-2003, American Chemical Society, United States (1994).
Strand, V., et al., "Biologic Therapies in Rheumatology: Lessons Learned, Future Directions," Nature Reviews Drug Discovery 6(1):75-92, Nature Publishing Group, England (2007).
Suzuki, T., et al., "Importance of Neonatal FcR in Regulating the Serum Half-life of Therapeutic Proteins Containing the Fc Domain of Human IgG1: a Comparative Study of the Affinity of Monoclonal Antibodies and Fc-fusion Proteins to Human Neonatal FcR," Journal of Immunology 184(4):1968-1976, American Association of Immunologists, United States (2010).
Tabrizi, M.A., et al., "Elimination Mechanisms of Therapeutic Monoclonal Antibodies," Drug Discovery Today 11(1-2):81-88, Virgin Mailing and Distribution, England (2006).
Tan, P.H., et al., "Engineering the Isoelectric Point of a Renal Cell Carcinoma Targeting Antibody Greatly Enhances scFV Solubility," Immunotechnology 4(2):107-114, Elsevier, Netherlands (1998).
Teeling, J.L., et al., "The Biological Activity of Human CD20 Monoclonal Antibodies is Linked to Unique Epitopes on CD20," Journal of Immunology 177(1):362-371, American Association of Immunologists, United States (2006).
Ten Kate, C.I., et al., "Effect of Isoelectric Point on Biodistribution and Inflammation: Imaging With Indium-111-labelled IgG," European Journal of Nuclear Medicine 17(6-8):305-309, Springer Verlag, Germany (1990).
Tsuchiya Credit Suisse Seminar "Therapeutic Antibody" at Fuji-Gotemba Laboratories , (2006), p. 21.

(56) References Cited

OTHER PUBLICATIONS

Tsurushita, N., et al., "Design of Humanized Antibodies: From Anti-Tac to Zenapax," Methods 36(1):69-83, Academic Press, United States (2005).

Vaisitti, T., et al., "Cationization of Monoclonal Antibodies: Another Step Towards the "Magic Bullet"?," Journal of Biological Regulators & Homeostatic Agents 19(3-4):105-112, Biolife, Italy (2005).

Vajdos, F.F., et al., "Comprehensive Functional Maps of the Antigen-Binding Site of an Anti-ErbB2 Antibody obtained with Shotgun Scanning Mutagenesis," Journal of Molecular Biology 320(2):415-428, Elsevier Science, United States (2002).

Van Walle, I., et al., "Immunogenicity Screening in Protein Drug Development," Expert Opinion on Biological Therapy 7(3):405-418, Taylor & Francis, Taylor & Francis (2007).

Vaughn, D.E. and Bjorkman, P.J., "Structural Basis of pH-dependent Antibody Binding by the Neonatal Fc Receptor," Structure 6(1):63-73, Cell Press, United States (1998).

Veri, M.C., et al., "Monoclonal Antibodies Capable of Discriminating the Human Inhibitory Fcgamma-receptor IIB (CD32B) From the Activating Fcgamma-receptor IIA (CD32A): Biochemical, Biological and Functional Characterization," Immunology 121(3):392-404, Blackwell Scientific, England (2007).

Ward, S.L. and Ingham, K.C., "A Calcium-binding Monoclonal Antibody That Recognizes a Non-calcium-binding Epitope in the Short Consensus Repeat Units (SCRs) of Complement C1r," Molecular Immunology 29(1):83-93, Pergamon Press, England (1992).

Wiens, G.D., et al., "Mutation of a Single Conserved Residue in VH Complementarity-determining Region 2 Results in a Severe Ig Secretion Defect," Journal of Immunology 167(4):2179-2186, American Association of Immunologists, United States (2001).

Wiens, G.D., et al., "Somatic Mutation in VH Complementarity-determining Region 2 and Framework Region 2: Differential Effects on Antigen Binding and Ig Secretion," Journal of Immunology 159(3):1293-1302, American Association of Immunologists, United States (1997).

Wikipedia, "Chaotropic agent" [online], [retrieved on Nov. 2, 2015]. Retrieved from the Inernet: https://en.wikipedia.org/wiki/Chaotropic_agent.

Wojciak, J.M., et al., "The Crystal Structure of Sphingosine-1-phosphate in Complex With a Fab Fragment Reveals Metal Bridging of an Antibody and Its Antigen," Proceedings of the National Academy of Sciences of the USA 106(42):17717-17722, National Academy of Sciences, United States (2009).

Xiang, J., et al., "Study of B72.3 Combining Sites by Molecular Modeling and Site-directed Mutagenesis," Protein Engineering 13(5):339-344, Oxford University Press, England (2000).

Yamamoto, T., et al., "Molecular Studies of pH-dependent Ligand Interactions With the Low-density Lipoprotein Receptor," Biochemistry 47(44):11647-11652, American Chemical Society, United States (2008).

Yamasaki, Y., et al., "Pharmacokinetic Analysis of In Vivo Disposition of Succinylated Proteins Targeted to Liver Nonparenchymal Cells Via Scavenger Receptors: Importance of Molecular Size and Negative Charge Density for In Vivo Recognition by Receptors," Journal of Pharmacology and Experimental Therapeutics 301(2):467-477, American Society for Pharmacology and Experimental Therapeutics, United States (2002).

Yang, K., et al., "Tailoring Structure-Function and Pharmacokinetic Properties of Single-chain Fv Proteins by Site-specific PEGylation," Protein Engineering 16(10):761-770, Oxford University Press, England (2003).

Yang, W.P., et al., "CDR Walking Mutagenesis for the Affinity Maturation of a Potent Human Anti-Hiv-1 Antibody into the Picomolar Range," Journal of Molecular Biology 254(3):392-403, Elsevier, England (1995).

Yeung, Y.A., et al., "Engineering Human IgG1 Affinity to Human Neonatal Fc Receptor: Impact of Affinity Improvement on Pharmacokinetics in Primates," Journal of Immunology 182(12):7663-7671, American Association of Immunologists, United States (2009).

Zalevsky J., et al., "The Impact of Fc Engineering on an Anti-CD19 Antibody: Increased Fcgamma Receptor Affinity Enhances B-cell Clearing in Nonhuman Primates," Blood 113(16):3735-3743, American Society of Hematology, United States (2009).

Zhou, T., et al., "Interfacial Metal and Antibody Recognition," Proceedings of the National Academy of Sciences of the USA 102(41):14575-14580, National Academy of Sciences, United States (2005).

Zhu, X., et al, "MHC Class I-related Neonatal Fc Receptor for Igg Is Functionally Expressed in Monocytes, Intestinal Macrophages, and Dendritic Cells," Journal of Immunology 166(5):3266-3276, American Association of Immunologists, United States (2001).

Zuckier, L.S., et al., "Chimeric Human-Mouse IgG Antibodies with Shuffled Constant Region Exons Demonstrate that Multiple Domains Contribute to In Vivo Half-Life," Cancer Research 58(17):3905-3908, American Association for Cancer Research, United States (1998).

Zwick, M.B., et al., "The Long Third Complementarity-determining Region of the Heavy Chain Is Important in the Activity of the Broadly Neutralizing Anti-human Immunodeficiency Virus Type 1 Antibody 2F5," Journal of Virology 78(6):3155-3161, American Society for Microbiology, United States (2004).

Office Action dated Nov. 23, 2016, in U.S. Appl. No. 13/595,139, Igawa, et al., filed Aug. 27, 2012.

Office Action dated Nov. 25, 2016, in U.S. Appl. No. 13/889,484, Igawa, et al., filed May 8, 2013.

Office Action dated Nov. 28, 2016, in U.S. Appl. No. 13/889,512, Igawa, et al., filed May 8, 2013.

Office Action dated Jan. 9, 2017, in U.S. Appl. No. 14/347,321, Igawa, T., et al., filed Mar. 26, 2014.

Radaev, S., et al., "The Structure of a Human Type III Fcgamma Receptor in Complex with Fc," The Journal of Biological Chemistry 276(19):16469-16477, American Society for Biochemistry and Molecular Biology, United States (2001).

Restriction Requirement, dated Dec. 22, 2016 in U.S. Appl. No. 14/379,825, Igawa, T., et al., filed Aug. 20, 2014.

Wang, W., et al., "Monoclonal Antibodies with Identical Fc Sequences can Bind to FcRn Differentially with Pharmacokinetic Consequences," Drug Metabolism and Disposition 39(9):1469-1477, American Society for Pharmacology and Experimental Therapeutics, United States (2011).

Amendment and Reply to Office Action dated Nov. 23, 2016 in U.S. Appl. No. 13/595,139, filed Mar. 22, 2017, 29 pages.

Coloma, M.J., et al., "Position Effects of Variable Region Carbohydrate on the Affinity and in Vivo Behavior of an Anti-(1--6) Dextran Antibody," Journal of Immunology 162(4):2162-2170, American Association of Immunologists, United States (1999).

Hird, V., et al, "Tumour Localisation With a Radioactively Labelled Reshaped Human Monoclonal Antibody," British Journal of Cancer 64(5):911-914, Nature Publishing Group, England (1991).

Hong., et al., "Enhanced Cellular Uptake and Transport of Polyclonal Immunoglobulin G and Fab After Their Cationization," Journal of Drug Targeting 8(2):67-77, Informa Healthcare, England (2000).

Li, B., et al., "Construction and Characterization of a Humanized Anti-human CD3 Monoclonal Antibody 12F6 With Effective Immunoregulation Functions," Immunology 116(4):487-498, Blackwell Scientific, England (2005).

Maurer, P.H., et al., "Antigenicity of Polypeptides (poly alpha amino acids): Calcium-dependent and Independent Antibodies," Journal of Immunology 105(3):567-573, American Association of Immunologists, United States (1970).

Mazda, O., et al., "Regulation of Muscle Homeostasis and Metabolism by the TGF-beta Superfamily Cytokine, Myostatin/growth Differentiation Factor 8 (GDF8)," Journal of Kyoto Prefectural University of Medicine 122(3):133-141 (2013).

Non-Final Office Action dated Feb. 27, 2017, in U.S. Appl. No. 14/377,556, Kuramochi, T. et al., filed Aug. 8, 2014.

(56) References Cited

OTHER PUBLICATIONS

Pardridge, W.M., et al., "Enhanced Cellular Uptake and in Vivo Biodistribution of a Monoclonal Antibody Following Cationization," Journal of Pharmaceutical Sciences 84(8):943-948, Elsevier, United States (1995).
Reimann, K.A., et al., "A Humanized Form of a CD4-specific Monoclonal Antibody Exhibits Decreased Antigenicity and Prolonged Plasma Half-life in Rhesus Monkeys While Retaining Its Unique Biological and Antiviral Properties," AIDS Research and Human Retroviruses 13(11):933-943, Mary Ann Liebert, United States (1997).
Restriction Requirement dated Dec. 15, 2016, in U.S. Appl. No. 14/377,556, Kuramochi, T. et al., filed Aug. 8, 2014.
Sharifi, J., et al., "Improving Monoclonal Antibody Pharmacokinetics via Chemical Modification," The Quarterly Journal of Nuclear Medicine 42(4):242-249, Minerva Medica, Italy (1998).
Singer, M., and Berg, P., "Genes & Genomes," Structure of Proteins 67-69 (1991).
Verhoeyen, M., et al., "Re-Shaped Human anti-PLAP Anitbodies," Chapter 5 in Monoclonal Antibodies in Clinical Oncology, eds. AA Epenetos, pp. 37-43, Chapman and Hall.
Verhoeyen, M.E., et al., "Construction of a Reshaped HMFG1 Antibody and Comparison of Its Fine Specificity With That of the Parent Mouse Antibody," Immunology 78(3):364-370, Blackwell Scientific, England (1993).
Borrok, M.J., et al., "ph-dependent Binding Engineering Reveals an FcRn Affinity Threshold That Governs IgG Recycling," The Journal of Biological Chemistry 290(7):4282-4290, American Society for Biochemistry and Molecular Biology, United States (2015).
Foote, J. and Winter, G., "Antibody Framework Residues Affecting the Conformation of the Hypervariable Loops," Journal of Molecular Biology 224(2):487-499, Elsevier, England (1992).
Gera, N., et al., "Design of pH Sensitive Binding Proteins from the Hyperthermophilic Sso7d Scaffold," PLoS One 7(11):e48928, Public Library of Science, United States (2012).
Hoogenboom, H.R., "Selecting and Screening Recombinant Antibody Libraries," Nature Biotechnology 23(9):1105-1116, Nature America Publishing, United States (2005).
Iwabe, T., et al., "Pathogenetic Significance of Increased Levels of Interleukin-8 in the Peritoneal Fluid of Patients with Endometriosis," Fertility and Sterility 69(5):924-930, Elsevier, United States (1998).
Knappik, A., et al., "Fully Synthetic Human Combinatorial Antibody Libraries (HuCAL) based on Modular Consensus Frameworks and CDRs Randomized with Trinucleotides," Journal of Molecular Biology 296(1):57-86, Elsevier, England (Feb. 2000).
Muller, Y.A., et al., "VEGF and the Fab Fragment of a Humanized Neutralizing Antibody: Crystal Structure of the Complex at 2.4 A Resolution and Mutational Analysis of the Interface," Structure 6(9):1153-1167, Cell Press, United States (1998).
Ober R.J., et al., "Visualizing the Site and Dynamics of IgG Salvage by the MHC Class I-related Receptor, FcRn1," The Journal of Immunology 172(4):2021-2029, The American Association of Immunologists (2004).
Office Action dated May 30, 2017, in U.S. Appl. No. 13/595,139, Igawa, T., et al., filed Aug. 27, 2012, 23 pages.
Office Action dated Jun. 14, 2017, in U.S. Appl. No. 14/347,187, Igawa, T., et al., filed Jul. 25, 2014, 22 pages.
Murata, V.M., et al., "Anti-digoxin Fab Variants Generated by Phage Display," Molecular Biotechnology 54(2):269-277, Humana Press, United States (2013).
Pejchal, R., et al., "A Conformational Switch in Human Immunodeficiency Virus gp41 Revealed by the Structures of Overlapping Epitopes Recognized by Neutralizing Antibodies," Journal of Virology 83(17):8451-8462, American Society for Microbiology, United States (2009).
Raposo, B., et al., "Epitope-specific Antibody Response is Controlled by Immunoglobulin V(H) Polymorphisms," The Journal of Experimental Medicine 211(3):405-411, Rockefeller University Press, United States (2014).
Janeway, Immunobiology, 5th Edition, Chapter 3, Garland Science, New York (2001).
Janeway, Immunobiology, 5th Edition, Chapter 4, Garland Science, New York (2001).
Fiedler, M., et al., "An Engineered IN-1 F(ab) Fragment with Improved Affinity for the Nogo-A Axonal Growth Inhibitor Permits Immunochemical Detection and Shows Enhanced Neutralizing Activity," Protein Engineering 15(11):931-941 (2002).
Final Office Action dated Jul. 7, 2017, in U.S. Appl. No. 14/377,556, Kuramochi, T. et al., filed Aug. 8, 2014.
Office Action dated Jan. 13, 2017, in U.S. Appl. No. 14/680,154, Hasegawa, M., et al., filed Apr. 7, 2015.
Office Action dated Jul. 20, 2017, in U.S. Appl. No. 14/379,825, Igawa, T., et al., filed Aug. 20, 2014.
Osbourn, J.K., et al., "Generation of a Panel of Related Human scFv Antibodies With High Affinities for Human CEA," Immunotechnology 2(3):181-196 (1996).
Pancook, J.D., et al., "In Vitro Affinity Maturation of Human IgM Antibodies Reactive With Tumor-associated Antigens," Hybridoma and Hybridomics 20(5-6):383-396 (2001).
Schier, R., et al., "Isolation of Picomolar Affinity anti-c-erbb-2 Single-chain Fv by Molecular Evolution of the Complementarity Determining Regions in the Center of the Antibody Binding Site," Journal of Molecular Biology 263(4):551-567 (1996).
Vidarsson, G., et al., "IgG Subclasses and Allotypes: from Structure to Effector Functions," Frontiers in Immunology 5(Article 520):17 pages, Lausanne (Oct. 2014).
Wu, H., et al., "Stepwise in Vitro Affinity Maturation of Vitaxin, an αvβ3-specific Humanized mAb," Proceedings of the National Academy of Sciences USA 95(11):6037-6042 (May 1998).
Glick, B. R., et al., "Molecular Biotechnology—Principles and Applications of Recombinant DNA," edited, p. 168, paragraph 5, (Mar. 2005), with English translation thereof.
U.S. Appl. No. 12/679,922, filed Sep. 26, 2008, related application.
U.S. Appl. No. 12/295,039, filed Mar. 30, 2007, related application.
U.S. Appl. No. 14/741,786, filed Jun. 17, 2015, related application.
U.S. Appl. No. 13/889,484, filed May 8, 2013, related application.
U.S. Appl. No. 13/889,512, filed May 8, 2013, related application.
U.S. Appl. No. 12/936,587, filed Apr. 10, 2009, related application.
U.S. Appl. No. 13/990,158, filed Nov. 30, 2011, related application.
U.S. Appl. No. 14/001,218, filed Feb. 24, 2012, related application.
U.S. Appl. No. 14/347,321, filed Sep. 28, 2012, related application.
U.S. Appl. No. 14/379,825, filed Feb. 22, 2013, related application.
U.S. Appl. No. 14/423,269, filed Aug. 23, 2013, related application.
U.S. Appl. No. 14/781,069, filed Apr. 2, 2014, related application.
U.S. Appl. No. 14/422,207, filed Aug. 23, 2013, related application.
U.S. Appl. No. 14/974,488, filed Dec. 18, 2015, related application.
U.S. Appl. No. 14/347,187, filed Jul. 25, 2014, related application.
U.S. Appl. No. 14/377,556, filed Aug. 8, 2014, related application.
U.S. Appl. No. 15/725,692, related application.
U.S. Appl. No. 525,596, 371(c) filed Oct. 26, 1995, related application.
U.S. Appl. No. 13/595,139, filed Aug. 27, 2012, related application.
U.S. Appl. No. 09/177,860, filed Oct. 23, 1998, related application.
U.S. Appl. No. 10/688,925, filed Oct. 21, 2003, related application.
U.S. Appl. No. 10/253,532, filed Sep. 25, 2002, related application.
Office Action dated Dec. 12, 2017, in U.S. Appl. No. 14/377,556, Kuramochi, T. et al., filed Aug. 8, 2014.
Merchant, A. M., et al., "An efficient route to human bispecific IgG," Nat Biotechnol 16:677-681 (1998).
Hamers-Casterman, C., et al., "Naturally occurring antibodies devoid of light chains," Nature 363:446-448 (1993).
Kuroda, D., et al,"Computer-aided antibody design," Protein Eng Des Sel, 25(10):507-521 (2012).
Final Office Action dated Jan. 19, 2018, in U.S. Appl. No. 14/347,187, Igawa, T. et al., filed Jul. 25, 2014.
Final Office Action dated Jan. 29, 2018, in U.S. Appl. No. 14/001,218, Mimoto, F. et al., filed Dec. 2, 2013.
Office Action dated Dec. 29, 2017, in U.S. Appl. No. 15/495,026, Igawa, T., et al., filed Apr. 24, 2017.
U.S. Appl. No. 11/410,886, filed Apr. 24, 2006, related application.
U.S. Appl. No. 11/503,062, filed Aug. 14, 2006, related application.
U.S. Appl. No. 12/156,183, filed May 30, 2008, related application.

(56) References Cited

OTHER PUBLICATIONS

U.S. Appl. No. 11/499,064, filed Aug. 3, 2006, related application.
Kim, Y. S., et al., "Production of a Polyclonal Anti-Myostatin Antibody and the Effects on In Ovo Administration of the Antibody of Posthatch Broiler Growth and Muscle Mass," Poultry Science 86:1196-1205 (2007).
Ying, J. and Xue, L., "Large Yellow Croaker MSTN-1 Prodomain Prokaryotic Expression, Polyclonal Antibody Preparation and Antibody Function Identification," Chinese J Cell Bio 36(10):1344-1349 (2014)(Abstract).
Breitbart, A., et al., "Highly Specific Detection of Myostatin Prodomain by an Immunoradiometric Sandwich Assay in Serum of Healthy Individual Individuals and Patients," PLoS One 8(11):e80454 (2013).
Search Report dated Jan. 3, 2018 in corresponding Singaporean Patent Application No. 11201700841Q, filed Dec. 18, 2015.
Fillipovic, "Biochemical basis of human life activity," VLADOS 49-50 (2005).
Fillipovic, "Biochemical basis of human life activity," VLADOS 38-43 (2005).
Restriction Requirement dated Jan. 26, 2017 in U.S. Appl. No. 14/347,187, Igawa, T., filed Jul. 25, 2014.
Janeway, C.A., et al., Immuno Biology, Third Edition, Garland Press, pp. 3:1-3:11, (1997).
Cooper, L. J., et al., "Variable domain-identical antibodies exhibit IgG subclass-related differences in affinity and kinetic constants as determined by surface plasmon resonance," Mol Immunol 31(8):577-584 (1994)(Abstract).
Tarditi, L., et al., "Selective high-performance liquid chromatographic purification of bispecific monoclonal antibodies," J. Chromatogr.; 599(1-2): 13-20 (1992).
Sondermann, P., et al., "The 3.2-Å crystal structure of the human IgG1 Fc fragment-FcγRIII complex," Nature; 406: 267-273 (Jul. 20, 2000).
Office Action dated Apr. 4, 2016, for commonly-owned U.S. Appl. No. 14/001,218.
Hironiwa, N., et al., "Calcium-Dependent Antigen Binding as a Novel Modality for Antibody Recycling by Endosomal Antigen Dissociation," mAbs 8(1):65-73, Taylor & Francis, Philadelphia (2016).
Maier, J.K.X., et al., "Assessment of Fully Automated Antibody Homology Modeling Protocols in Molecular Operating Environment," Proteins 82(8):1599-1610, Wiley-Liss, New York (2014).
Office Action dated Feb. 7, 2017, in U.S. Appl. No. 14/422,207, Igawa, T., et al., filed Feb. 18, 2015.

— association: 1.2mM CaCl$_2$-pH7.4, dissociation: 1.2mM CaCl$_2$-pH7.4
— association: 1.2mM CaCl$_2$-pH7.4, dissociation: 3uM CaCl$_2$-pH5.8

IL-8 ANTIBODIES

CROSS-REFERENCE TO RELATED APPLICATIONS

This application is related to and claims priority to Japanese Priority Patent Applications No. 2015-021371, filed in Japan on Feb. 5, 2015, and No. 2015-185254, filed in Japan on Sep. 18, 2015. The content of these applications is incorporated by reference in their entirety.

REFERENCE TO SEQUENCE LISTING

This application includes a "Sequence Listing.ascii.txt," 823,904 bytes, created on Feb. 3, 2016, and submitted electronically via EFS-Web, which is hereby incorporated by reference in its entirety.

TECHNICAL FIELD

In one nonexclusive aspect, the disclosure relates to antibodies comprising an antigen-binding domain whose antigen-binding activity changes according to the ion concentration condition and pharmacuetic compositions containing the antibodies. Nucleic acids ecoding these antibodies and host cells containing the nucleic acids are also provided, as are uses and production methods of the antibodies and pharmaceutical compositions. In another nonexclusive aspect, the disclosure provides Fc region variants and antibodies containing such variants and pharmaceutical compositions containing the Fc region variants and antibodies. Nucleic acids ecoding the Fc region variants and antibodies, and host cells containing the nucleic acids are also provided, as are uses and production methods of the Fc region variants and antibodies and pharmaceutical compositions. In a third non-exclusive aspect, the disclosure provides anti-IL-8 antibodies, pharmaceutical compositions containing the antibodies, nucleic acids encoding the antibodies, and host cells containing the nucleic acids. Production methods and uses of the IL-8 antibodies and pharmaceutical composition in the treatment of for example, IL-8-associated disorders, are also provided.

BACKGROUND

Antibodies attract attention as pharmaceuticals because they are highly stable in plasma and have few side effects. A number of IgG-type therapeutic antibodies are on the market, and even now many therapeutic antibodies are under development (Reichert et al., *Nat. Biotechnol.* 23:1073-1078 (2005); Pavlou et al., *Eur. J. Pharm. Biopharm.* 59(3):389-396 (2005)). Meanwhile, various techniques are being developed for second-generation therapeutic antibodies; including technologies for improving effector function, antigen-binding ability, pharmacokinetics or stability, and reducing the risk of immunogenicity (Kim et al., *Mol. Cells.* 20 (1):17-29 (2005)). The dosage for therapeutic antibodies is generally very high, and consequently the development of therapeutic antibodies confronts issues such as difficulty in producing subcutaneous formulations and high production costs. Methods for improving therapeutic antibody pharmacokinetics, pharmacodynamics, and antigen binding properties provide ways to reduce the dosage and production costs associated with therapeutic antibodies.

The substitution of amino acid residues in the constant region provides one method for improving antibody pharmacokinetics (Hinton et al., *J. Immunol.* 176 (1):346-356 (2006); Ghetie et al., *Nat. Biotechnol.* 15(7):637-640 (1997)). The technique of affinity maturation provides a method for enhancing antigen-neutralizing ability of an antibody (Rajpal et al., *Proc. Natl. Acad. Sci. USA* 102(24): 8466-8471 (2005); Wu et al., *J. Mol. Biol.* 368:652 (2007)), and may increase the antigen-binding activity by introducing mutation(s) into amino acid residue(s) in the CDRs and/or framework regions of an antibody variable domain. Improving the antigen-binding properties of an antibody may improve the biological activity of the antibody in vitro or reduce the dosage, and may further improve the efficacy in vivo (in the body) (Wu et al., *J. Mol. Biol.* 368:652-665 (2007)).

The amount of antigen that can be neutralized by one antibody molecule depends on the affinity of the antibody for the antigen; and thus, it is possible to neutralize an antigen with a small amount of antibody by increasing affinity. Antibody affinity for an antigen may routinely be increased using various known methods (see, e.g., Rajpal et al., *Proc. Natl. Acad. Sci. USA* 102(24):8466-8471 (2005)). Further, it is theoretically possible to neutralize one antigen molecule (2 antigens when an antibody is bivalent) with one antibody molecule, if it can bind covalently to the antigen to make the affinity infinite. Nevertheless, one limitation for therapeutic antibody development thus far is that one antibody molecule typically only binds to and neutralizes one antigen molecule (2 antigens when an antibody is bivalent). Recently it has been reported that the use of an antibody that binds to an antigen in a pH-dependent manner (herein below also referred to as "pH-dependent antibody" or "pH-dependent-binding antibody") enables one antibody molecule to bind to and neutralize multiple antigen molecules (see, e.g., WO2009/125825; Igawa et al., *Nat. Biotechnol.* 28:1203-1207 (2010)). A pH-dependent antibody binds to an antigen strongly under the neutral pH conditions in the plasma, and dissociates from the antigen under the acidic pH condition within the endosome of a cell. After dissociation from the antigen, the antibody is recycled to the plasma by FcRn and is then free to bind to and neutralize another antigen molecule; and thus one pH-dependent antibody may repeatedly bind to and neutralize multiple antigen molecules.

It has recently been reported that antibody recycling properties can be achieved by focusing on the difference of calcium (Ca) ion concentration between plasma and endosome, and using an antibody with an antigen-antibody interaction that demonstrates calcium dependency (herein below also referred to as "calcium ion concentration-dependent antibody")(WO2012/073992). (Herein below, a pH-dependent antibody and a "calcium ion concentration-dependent antibody" are collectively referred to as a "pH/Ca concentration-dependent antibody".)

By binding to FcRn, IgG antibodies have long retention in plasma. The binding between an IgG antibody and FcRn is strong under an acidic pH conditions (for example, pH 5.8), but there is almost no binding under a neutral pH condition (for example, pH 7.4). An IgG antibody is taken up into cells non-specifically, and returned to cell surface by binding to FcRn in the endosome under the acidic pH conditions in the endosome. The IgG then dissociates from the FcRn under the neutral pH conditions in the plasma.

It is reported that a pH-dependent antibody that has been modified to increase its FcRn binding under neutral pH conditions has the ability to repeatedly bind to and eliminate antigen molecules from plasma; and thus administration of such an antibody allows antigen elimination from plasma (WO2011/122011). According to this report, a pH-dependent antibody that has been modified to increase its FcRn binding under neutral pH conditions (for example, pH 7.4) can further accelerate the elimination of the antigen compared to a pH-dependent antibody that comprises the Fc region of a native IgG antibody (WO2011/122011).

Meanwhile, when mutations are introduced into the Fc region of an IgG antibody to eliminate its binding to FcRn under acidic pH conditions, it can no longer be recycled from the endosome into the plasma, which significantly compromises the antibody's retention in the plasma. With that, a method of increasing FcRn binding under acidic pH conditions is reported as a method for improving the plasma retention of an IgG antibody. Introducing amino acid modifications into the Fc region of an IgG antibody to increase its FcRn binding under acidic pH conditions can enhance the efficacy of recycling from the endosome to plasma, which as a result leads to an improvement in plasma retention. For instance, the modifications M252Y/S254T/T256E (YTE; Dall'Acqua et al., *J. Biol. Chem.* 281:23514-235249 (2006)), M428L/N434S (LS; Zalevsky et al., *Nat. Biotechnol.* 28:157-159 (2010)), and N434H (Zheng et al., *Clin. Pharm. & Ther.* 89(2):283-290 (2011)), have been reported to result in increased antibody half-life relative to native IgG1.

However, in addition to the concern that the immunogenicity or occurrence rate of aggregates may worsen in an antibody that comprises such an Fc region variant whose FcRn binding is increased under a neutral pH condition or an acidic pH condition, an increase in the binding against an anti-drug antibody (herein below also referred to as "Pre-existing ADA") (for example, rheumatoid factor) present in a patient before administration of a therapeutic antibody has been further reported (WO2013/046722, WO2013/046704). WO2013/046704 reports that an Fc region variant containing specific mutations (represented by two residue modifications of Q438R/S440E according to EU numbering) increase the binding to FcRn under acidic pH conditions and also showed a significant reduction in binding to rheumatoid factor compared to unmodified native Fc. However, WO2013/046704 does not specifically demonstrate that this Fc region variant has superior plasma retention to an antibody with native Fc region.

Accordingly, safe and more favorable Fc region variants with further improved plasma retention that do not show binding to pre-existing ADA are desired.

Antibody-dependent cellular cytotoxicity (herein below noted as "ADCC"), complement-dependent cytotoxicity (herein below noted as "CDC"), antibody-dependent cellular phagocytosis (ADCP) which is phagocytosis of target cells mediated by an IgG antibody are reported as effector functions of an IgG antibody. In order for an IgG antibody to mediate ADCC activity or ADCP activity, the Fc region of the IgG antibody must bind to an antibody receptor present on the surface of an effector cell such as a killer cell, natural killer cell or activated macrophage (noted as "Fcγreceptor", "FcgR", "Fc gamma receptor" or "FcγR" within the scope of Disclosure A described herein). In human, FcγRIa, FcγRIIa, FcγRIIb, FcγRIIIa and FcγRIIIb isoforms are reported as FcγR family proteins, and their respective allotypes have also been reported (Jefferis et al., *Immunol. Lett.* 82:57-65 (2002)). The balance of the respective affinity of an antibody for an activating receptor comprising FcγRIa, FcγRIIa, FcγRIIIa or FcγRIIIb, and an inhibitory receptor comprising FcγRIIb is an important element in optimizing the antibody effector functions.

Various techniques that increase or improve the activity of a therapeutic antibody against an antigen have been reported so far. For instance, the activity of an antibody to bind to an activating FcγR(s) plays an important role in the cytotoxicity of the antibody, and consequently, antibodies that target a membrane-type antigen and that have increased cytotoxicity resulting from enhanced activating FcγR(s) binding have been developed. See, e.g., WO2000/042072; WO2006/019447; Lazar et al., *Proc. Nat. Acad. Sci. USA.* 103:4005-4010 (2006); Shinkawa et al., *J. Biol. Chem.* 278, 3466-3473 (2003); Clynes et al., *Proc. Natl. Acad. Sci. USA* 95:652-656 (1998); Clynes et al., *Nat. Med.* 6:443-446 (2000)). Similarly, the binding activity towards an inhibitory FcγR (FcγRIIb in human) plays an important role in the immunosuppressive activity, agonist activity, and thus there has been research on antibodies with increased inhibitory FcγR-binding activity that target a membrane-type antigen (Li et al., *Proc. Nat. Acad. Sci. USA.* 109 (27):10966-10971 (2012)). Further, the influence of FcγR binding of an antibody that binds to a soluble antigen has been examined mainly from the viewpoint of side effects (Scappaticci et al., *J. Natl. Cancer Inst.* 99 (16):1232-1239 (2007)). For instance, when an antibody with increased FcγRIIb binding is used as a drug, one can expect reduced risk from the generation of anti-drug antibodies (Desai et al., *J. Immunol.* 178(10):6217-6226 (2007)).

More recently, it has been reported that introducing amino acid modifications into the Fc region of an IgG antibody to increase the activity of an antibody that targets a soluble antigen to bind to an activating and/or inhibitory FcγR(s) can further accelerate elimination of the antigen from serum (WO2012/115241, WO2013/047752, WO2013/125667, WO2014/030728). Also, an Fc region variant has been identified, which shows almost no change in its FcγRIIb-binding activity from a native IgG antibody Fc region, but has reduced activity to other activating FcγRs (WO2014/163101).

The plasma retention of a soluble antigen is very short compared to an antibody that has an FcRn-mediated recycling mechanism, and thus a soluble antigen may display increased plasma retention and plasma concentration by binding to an antibody that has such a recycling mechanism (for example, an antibody that does not have the characteristics of a pH/Ca concentration-dependent antibody). Accordingly, for example, when a soluble antigen in plasma has multiple types of physiological functions, even if one type of physiological functions is blocked as a result of antibody binding, the plasma concentration of the antigen may worsen the pathogenic symptoms caused by the other physiological functions as a result of the increased plasma retention and/or plasma concentration of the antigen resulting from the antibody binding. In this case, in addition to a method of applying the above-mentioned exemplified modifications to an antibody to accelerate antigen elimination, for example, a method of utilizing the formation of a multivalent immune complex from multiple pH/Ca concentration-dependent antibodies and multiple antigens, and increasing the binding to FcRn, FcγR(s), a complement receptor, has been reported (WO2013/081143).

Even when the Fc region is not modified, it is reported that by modifying amino acid residue(s) so as to change the charge of such amino acid residue(s) which may be exposed on the surface of an antibody variable region to increase or decrease the isoelectric point (pI) of the antibody, it is possible to control the half-life of the antibody in blood regardless of the type of target antigen or antibody, and without substantially reducing the antigen-binding activity of the antibody (WO2007/114319: techniques of substituting amino acids mainly in the FR; WO2009/041643: techniques of substituting amino acids mainly in CDR). These documents show that it is possible to prolong the plasma half-life of an antibody by reducing the antibody's pI, and conversely shorten the plasma half-life of an antibody by increasing the antibody's pI.

With regard to modification of the charge of amino acid residues in the constant region of an antibody, it has been reported that the uptake of an antigen into cells can be promoted by modifying the charge of specific amino acid residue(s), particularly in its CH3 domain, to increase the antibody's pI, and it is also described that this modification preferably does not interfere with the binding to FcRn (WO2014/145159). It has also been reported that modifying the charge of amino acid residues in the constant region (mainly CH1 domain) of an antibody to reduce pI can prolong the half-life of the antibody in plasma, and in combination with mutations of amino acid residues to increase FcRn binding, can enhance its binding to FcRn and prolong the plasma half-life of the antibody (WO2012/016227).

Meanwhile, when such modification techniques designed for increasing or reducing the pI of an antibody are combined with techniques other than the modification technique to increase or reduce the binding to FcRn or FcγR(s), it is unclear whether there is an effect in promoting the plasma retention of the antibody or elimination of the antigen from plasma.

The extracellular matrix (ECM) is a structure that covers cells in vivo, and is mainly constituted by glycoproteins such as collagen, proteoglycan, fibronectin, and laminin. The role of the ECM in vivo is to create a microenvironment for cells to survive, and the ECM is important in various functions carried out by cells such as, cell proliferation and cell adhesion.

The ECM has been reported to be involved in the in vivo kinetics of proteins administered to a living body. Blood concentration of the VEGF-Trap molecule, which is a fusion protein between the VEGF receptor and Fc, when subcutaneously administered was examined (Holash et al., *Proc. Natl. Acad. Sci.*, 99(17):11393-11398 (2002)). Plasma concentration of the subcutaneously administered VEGF-Trap molecule which has a high pI, was low, and therefore its bioavailability was low. A modified VEGF-Trap molecule whose pI was reduced by amino acid substitutions has a higher plasma concentration, and its bioavailability could be improved. Further, change in the bioavailability correlates with the strength of binding to the ECM, and thus it became evident that the bioavailability of the VEGF-Trap molecule when subcutaneously administered depends on the strength of its binding to the ECM at the subcutaneous site.

WO2012/093704 reports that there is an inverse correlation between antibody binding to the ECM and plasma retention, and consequently, antibody molecules that do not bind to the ECM have better plasma retention when compared to antibodies that bind to the ECM.

As such, techniques for reducing extracellular matrix binding with the objective of improving protein bioavailability in vivo and plasma retention have been reported. By contrast, the advantages of increasing antibody binding to the ECM have not been identified so far.

Human IL-8 (Interleukin 8) is a chemokine family member that is 72 or 77 amino acid residues in length. The term "chemokine" is a collective term for a family of proteins with a molecular weight of 8-12 kDa and contain 4 cysteine residues that form intermolecular disulfide bonds. Chemokines are categorized into CC chemokine, CXC chemokine, C chemokine, CA3C chemokine according to the characteristics of the cysteine arrangement. IL-8 is classified as a CXC chemokine, and is also referred to as CXCL8.

IL-8 exists in solution in monomeric and homodimeric form. The IL-8 monomer contains antiparallel β sheets, and has a structure in which a C-terminal a helix traverses and covers the β sheets. An IL-8 monomer, in the case of the 72 amino acid form of IL-8, comprises two disulfide crosslinks between cysteine 7 and cysteine 34, and between cysteine 9 and cysteine 50. IL-8 homodimers are stabilized by noncovalent interactions between the β sheets of the two monomers, as there is no covalent binding between molecules in homodimers.

IL-8 expression is induced in various cells such as peripheral blood monocytes, tissue macrophages, NK cells, fibroblasts, and vascular endothelial cells in response to stimulation by inflammatory cytokines (Russo et al., *Exp. Rev. Clin. Immunol.* 10(5):593-619 (2014)).

Chemokines are generally not detectable, or only weakly detectable, in normal tissue, but are strongly detected at inflamed sites, and are involved in eliciting inflammation by facilitating infiltration of leukocyte into inflamed tissue sites. IL-8 is a proinflammatory chemokine that is known to activate neutrophils, promote expression of cell adhesion molecules, and enhance neutrophil adhesion to vascular endothelial cells. IL-8 also has neutrophil chemotactic capacity and IL-8 produced at a damaged tissue facilitates chemotaxis of neutrophils adhered to vascular endothelial cells into the tissue, and induces inflammation along with neutrophil infiltration. IL-8 is also known to be a potent angiogenic factor for endothelial cells and is involved in promoting tumor angiogenesis.

Inflammatory diseases associated with elevated (e.g., excess) IL-8 levels include, inflammatory diseases of the skin such as inflammatory keratosis (e.g., psoriasis), atopic dermatitis, contact dermatitis; chronic inflammatory disorders which are autoimmune diseases, such as rheumatoid arthritis, systemic lupus erythematosus (SLE), and Behcet's disease; inflammatory bowel diseases such as Crohn's disease and ulcerative colitis; inflammatory liver diseases such as hepatitis B, hepatitis C, alcoholic hepatitis, drug-induced allergic hepatitis; inflammatory renal diseases such as glomerulonephritis; inflammatory respiratory diseases such as bronchitis and asthma; inflammatory chronic vascular diseases such as atherosclerosis; multiple sclerosis, oral ulcer, chorditis, and inflammation associated with using artificial organs and/or artificial blood vessels. Elevated (e.g., excess) IL-8 levels are also associated with malignant tumors such as ovarian cancer, lung cancer, prostate cancer, stomach cancer, breast cancer, melanoma, head and neck cancers, and kidney cancer; sepsis due to infection; cystic fibrosis; and pulmonary fibrosis. (See, e.g., Russo et al., *Exp. Rev. Clin. Immunol.* 10(5):593-619 (2014), which is herein incorporated by reference in its entirety).

For several of these diseases, human anti-IL-8 antibodies with high affinity have been developed as pharmaceutical compositions (Desai et al., *J. Immunol.* 178(10):6217-6226 (2007)), however, they have not been launched yet. So far, only one pharmaceutical composition comprising IL-8 antibody is available, which is a murin anti-IL-8 antibody for psoriasis as external medicine. New anti-IL-8 antibodies for treatment diseases are expected.

BRIEF SUMMARY

In one nonexclusive aspect, a non-limited objective of embodiments of Disclosure A is to provide molecules with improved pharmacokinetic properties over antibodies, such as ion concentration-dependent antigen binding properties that improve antibody half-life and/or antigen clearance from the plasma.

In one nonexclusive aspect, a non-limited objective of embodiments of Disclosure B is to provide, safe and more favorable Fc region variants that have increased half-life and decreased binding to pre-existing anti-drug antibodies (ADAs).

In one nonexclusive aspect, a non-limited objective of embodiments of Disclosure C is to provide anti-IL-8 antibodies that have pH-dependent binding affinity towards IL-8. An additional embodiment relates to anti-IL-8 antibodies that have an effect of rapidly eliminating IL-8 compared to a reference antibody when administered to an individual. In another embodiment, Disclosure C relates to anti-IL-8 antibodies that can stably maintain their IL-8-neutralizing activity when administered to an individual. In some embodiments, the anti-IL-8 antibodies display reduced immunogenicity. In additional embodiments, Disclosure C relates to a method of producing and using the above-mentioned anti-IL-8 antibodies. Another alternative non-limited objective of Disclosure C is, to provide novel anti-IL-8 antibodies that can be included in a pharmaceutical composition.

In one nonexclusive aspect, within the scope of Disclosure A as provided herein, the inventors have surprisingly discovered that the ability of an ion concentration-dependent antibody (which is an antibody comprising an ion concentration-dependent antigen-binding domain ("an antigen-binding domain whose antigen-binding activity changes according to ion concentration conditions")) to eliminate antigen from plasma can be accelerated by modifying at least one of the amino acid residues exposed on the surface of the antibody to increase its isoelectric point (pI). In another nonexclusive aspect, the inventors discovered that an ion concentration-dependent antibody with increased pI can further increase the extracellular matrix-binding of the antibody. Thus, without being confined to a particular theory, the inventors have discovered that antigen elimination from plasma can be increased, by increasing the binding of the antibody towards extracellular matrix.

In one nonexclusive aspect, within the scope of Disclosure B as provided herein, the inventors conducted dedicated research on safe and more favorable Fc region variants that do not show binding to anti-drug antibodies (pre-existing ADA) and that can further improve plasma retention. As a result, the inventors have surprisingly discovered that Fc region variants comprising a substitution of position 434 amino acid according to EU numbering with Ala (A) and two specific residue mutations (represented by Q438R/S440E according to EU numbering) as a combination of amino acid residue mutations, are preferred for maintaining significant reduction in the binding to rheumatoid factor, along with achieving a plasma retention of an antibody.

In one nonexclusive aspect, within the scope of Disclosure C as provided herein, the inventors generated a number of pH-dependent anti-IL-8 antibodies (anti-IL-8 antibodies that bind to IL-8 in a pH-dependent manner). From the results of various validations, the inventors identified pH-dependent anti-IL-8 antibodies that have an effect of rapidly eliminating IL-8 compared to a reference antibody when administered to an individual. In some embodiments the Disclosure C relates to pH-dependent anti-IL-8 antibodies that can stably maintain their IL-8-neutralizing activity. In additional nonlimiting embodiments, the pH-dependent anti-IL-8 antibodies have reduced immunogenicity and excellent expression levels.

Further, within the scope of Disclosure C, the inventors successfully obtained anti-IL-8 antibodies that comprise an Fc region whose FcRn-binding affinity at acidic pH is increased relative to the FcRn-binding affinity of a native Fc region. In an alternative aspect, the inventors successfully obtained anti-IL-8 antibodies that comprise an Fc region whose binding affinity towards pre-existing ADA is reduced relative to the binding affinity of a native Fc region for the pre-existing ADA. In an alternative aspect, the inventors successfully obtained anti-IL-8 antibodies comprising an Fc region that whose plasma half-life is increased relative to the plasma half-life of a native Fc region. In an alternative aspect, the inventors successfully obtained pH-dependent anti-IL-8 antibodies that comprise an Fc region whose binding affinity towards effector receptors is reduced relative to the binding affinity of a naturally occurring Fc region for the effector receptors. In a different aspect, the inventors identified nucleic acids encoding the above-mentioned anti-IL-8 antibodies. In another aspect, the inventors also obtained hosts comprising the above-mentioned nucleic acids. In another aspect, the inventors developed a method for producing the above-mentioned anti-IL-8 antibodies, which comprises culturing the above-mentioned host. In another aspect, the inventors developed a method for facilitating the elimination of IL-8 from an individual relative to a reference antibody, which comprises administering the above-mentioned anti-IL-8 antibodies to the individual.

In one embodiment, Disclosure A, relates without limitation to,

[1] an antibody comprising an antigen-binding domain whose antigen-binding activity changes according to ion concentration conditions, wherein its isoelectric point (pI) is increased by the modification of at least one amino acid residue that may be exposed on the surface of the antibody;

[2] the antibody of [1], wherein the antigen is a soluble antigen;

[3] the antibody of [1] or [2], wherein the antigen-binding domain is a domain whose antigen-binding activity under a high ion concentration condition is higher than that under a low ion concentration condition;

[4] the antibody of any one of [1] to [3], wherein the ion concentration is a hydrogen ion concentration (pH) or a calcium ion concentration;

[5] the antibody of [4], wherein the ratio of its KD in an acidic pH range to that in a neutral pH range, KD (acidic pH range)/KD (neutral pH range), for the antigen, is 2 or higher;

[6] the antibody of any one of [1] to [5], wherein in the antigen-binding domain, at least one amino acid residue is substituted with histidine, or at least one histidine is inserted;

[7] the antibody of any one of [1] to [6], which can promote elimination of the antigen from plasma as compared to an antibody before the modification;

[8] the antibody of any one of [1] to [7], wherein its extracellular matrix-binding activity is enhanced as compared to an antibody before the modification;

[9] the antibody of any one of [1] to [8], wherein the amino acid residue modification is amino acid residue substitution;

[10] the antibody of any one of [1] to [9], wherein the amino acid residue modification is selected from the group consisting of:
(a) substitution of a negatively charged amino acid residue with an uncharged amino acid residue;

(b) substitution of a negatively charged amino acid residue with a positively charged amino acid residue; and
(c) substitution of an uncharged amino acid residue with a positively charged amino acid residue;

[11] the antibody of any one of [1] to [10], wherein the antibody comprises a variable region and/or a constant region, and the amino acid residue modification is amino acid residue modification in the variable region and/or the constant region;

[12] the antibody of [11], wherein the variable region comprises complementarity-determining region(s) (CDR(s)) and/or framework region(s) (FR(s));

[13] the antibody of [12], wherein the variable region comprises a heavy chain variable region and/or a light chain variable region, and at least one amino acid residue is modified in a position in a CDR or a FR selected from the group consisting of:
(a) position 1, 3, 5, 8, 10, 12, 13, 15, 16, 18, 19, 23, 25, 26, 39, 41, 42, 43, 44, 46, 68, 71, 72, 73, 75, 76, 77, 81, 82, 82a, 82b, 83, 84, 85, 86, 105, 108, 110, and 112 in a FR of the heavy chain variable region;
(b) position 31, 61, 62, 63, 64, 65, and 97 in a CDR of the heavy chain variable region;
(c) position 1, 3, 7, 8, 9, 11, 12, 16, 17, 18, 20, 22, 37, 38, 39, 41, 42, 43, 45, 46, 49, 57, 60, 63, 65, 66, 68, 69, 70, 74, 76, 77, 79, 80, 81, 85, 100, 103, 105, 106, 107, and 108 in a FR of the light chain variable region; and
(d) position 24, 25, 26, 27, 52, 53, 54, 55, and 56 in a CDR of the light chain variable region, according to Kabat numbering;

[14] the antibody of [13], wherein at least one amino acid residue is modified in a position in a CDR or a FR selected from the group consisting of:
(a) position 8, 10, 12, 13, 15, 16, 18, 23, 39, 41, 43, 44, 77, 82, 82a, 82b, 83, 84, 85, and 105 in a FR of the heavy chain variable region;
(b) position 31, 61, 62, 63, 64, 65, and 97 in a CDR of the heavy chain variable region;
(c) position 16, 18, 37, 41, 42, 45, 65, 69, 74, 76, 77, 79, and 107 in a FR of the light chain variable region; and
(d) position 24, 25, 26, 27, 52, 53, 54, 55, and 56 in a CDR of the light chain variable region;

[15] the antibody of any one of [11] to [14], wherein at least one amino acid residue is modified in a position in the constant region selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering;

[16] the antibody of [15], wherein at least one amino acid residue is modified in a position in the constant region selected from the group consisting of position 254, 258, 281, 282, 285, 309, 311, 315, 327, 330, 342, 343, 345, 356, 358, 359, 361, 362, 384, 385, 386, 387, 389, 399, 400, 401, 402, 413, 418, 419, 421, 433, 434, and 443;

[17] the antibody of [16], wherein at least one amino acid residue is modified in a position in the constant region selected from the group consisting of position 282, 309, 311, 315, 342, 343, 384, 399, 401, 402, and 413, according to EU numbering;

[18] the antibody of any one of [1] to [17], wherein the constant region has Fc gamma receptor (FcγR)-binding activity, and wherein the FcγR-binding activity under a neutral pH condition is enhanced as compared to that of a reference antibody comprising a constant region of a native IgG;

[19] the antibody of [18], wherein the FcγR is FcγRIIb;

[20] the antibody of any one of [1] to [17], wherein the constant region has binding activity towards one or more activating FcγR selected from the group consisting of FcγRIa, FcγRIb, FcγRIc, FcγRIIIa, FcγRIIIb and FcγRIIa, and towards FcγRIIb, and the FcγRIIb-binding activity is maintained or enhanced and the binding activity to the activating FcγRs is decreased, as compared to those of a reference antibody which differs only in that its constant region is that of a native IgG;

[21] the antibody of any one of [1] to [20], wherein the constant region has FcRn-binding activity, and wherein the FcRn-binding activity under a neutral pH condition (e.g., pH 7.4) is enhanced as compared to that of a reference antibody which differs only in that its constant region is that of a native IgG;

[22] the antibody of any one of [1] to [21], which is a multispecific antibody that binds to at least two antigens;

[23] the antibody of any one of [1] to [22], wherein the antibody is an IgG antibody;

[24] a pharmaceutical composition comprising the antibody of any one of [1] to [23];

[25] the pharmaceutical composition of [24], which is for promoting the elimination of an antigen from plasma;

[26] the pharmaceutical composition of [24] or [25], which is for enhancing the antibody binding to an extracellular matrix;

[27] a nucleic acid encoding the antibody of any one of [1] to [23];

[28] a vector comprising the nucleic acid of [27];

[29] a host cell comprising the vector of [28];

[30] a method for producing an antibody comprising an antigen-binding domain whose antigen-binding activity changes according to ion concentration conditions, wherein the method comprises culturing the host cell of [29] and collecting the antibody from the cell culture;

[30A] a method for producing an antibody comprising an antigen-binding domain whose antigen-binding activity changes according to ion concentration conditions, wherein the method comprises modifying at least one amino acid residue that may be exposed on the surface of the antibody so as to increase the isoelectric point (pI);

[30B] the method of [30A], wherein at least one amino acid residue is modified
(I) in a position in a CDR or FR selected from the group consisting of: (a) position 1, 3, 5, 8, 10, 12, 13, 15, 16, 18, 19, 23, 25, 26, 39, 41, 42, 43, 44, 46, 68, 71, 72, 73, 75, 76, 77, 81, 82, 82a, 82b, 83, 84, 85, 86, 105, 108, 110, and 112 in a FR of the heavy chain variable region; (b) position 31, 61, 62, 63, 64, 65, and 97 in a CDR of the heavy chain variable region; (c) position 1, 3, 7, 8, 9, 11, 12, 16, 17, 18, 20, 22, 37, 38, 39, 41, 42, 43, 45, 46, 49, 57, 60, 63, 65, 66, 68, 69, 70, 74, 76, 77, 79, 80, 81, 85, 100, 103, 105, 106, 107, and 108 in a FR of the light chain variable region; and (d) position 24, 25, 26, 27, 52, 53, 54, 55, and 56 in a CDR of the light chain variable region, according to Kabat numbering; or
(II) in a position in a constant region selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering;

[31] the method of [30A] or [30B], wherein the amino acid residue modification comprises a modification selected from the group consisting of:

(a) substitution of a negatively charged amino acid residue with an uncharged amino acid residue;
(b) substitution of a negatively charged amino acid residue with a positively charged amino acid residue;
(c) substitution of an uncharged amino acid residue with a positively charged amino acid residue; and
(d) substitution or insertion with histidine in a CDR or FR.

[32] the method of any one of [30], or [30A] to [30C] which further optionally comprises any one or more of:
(a) selecting an antibody which can promote elimination of an antigen from plasma;
(b) selecting an antibody with enhanced binding activity to an extracellular matrix;
(c) selecting an antibody with enhanced FcγR-binding activity under a neutral pH condition (e.g., pH 7.4);
(d) selecting an antibody with enhanced FcγRIIb-binding activity under a neutral pH condition (e.g., pH 7.4);
(e) selecting an antibody with maintained or enhanced FcγRIIb-binding activity and decreased binding activity to one or more activating FcγR, preferably selected from the group consisting of FcγRIa, FcγRIb, FcγRIc, FcγRIIIa, FcγRIIIb and FcγRIIa;
(f) selecting an antibody with enhanced FcRn-binding activity under a neutral pH condition (e.g., pH 7.4);
(g) selecting an antibody with an increased isoelectric point (pI);
(h) confirming the isoelectric point (pI) of the collected antibody, and then selecting an antibody with an increased isoelectric point (pI); and
(i) selecting an antibody whose antigen-binding activity is changed or increased according to ion concentration conditions;
as compared to a reference antibody;

In an alternative embodiment, Disclosure A relates without limitation to:

[A1] an antibody having a constant region, wherein at least one amino acid residue selected from the group of modification sites identical to the modification sites in the group defined in [15] or [16] is modified in the constant region;

[A2] the antibody of [A1], which further has a heavy-chain variable region and/or a light-chain variable region, wherein the variable region has CDR(s) and/or FR(s), and wherein at least one amino acid residue selected from the group of modification sites identical to the modification sites in the group defined in [13] or [14] is modified in a CDR and/or a FR;

[A3] an antibody having a constant region, wherein at least one amino acid residue selected from the group of modification sites identical to the modification sites in the group defined in [15] or [16] is modified in the constant region so as to increase its pI;

[A4] the antibody of [A3], which further has a heavy-chain variable region and/or a light-chain variable region, wherein the variable region has CDR(s) and/or FR(s), and wherein at least one amino acid residue selected from the group of modification sites identical to the modification sites in the group defined in [13] or [14] is modified in a CDR and/or a FR;

[A5] an antibody comprising an antigen-binding domain whose antigen-binding activity changes according to ion concentration conditions, wherein the antibody has a constant region, and wherein at least one amino acid residue selected from the group of modification sites identical to the modification sites in the group defined in [15] or [16] is modified in the constant region;

[A6] the antibody of [A5], which further has a heavy-chain variable region and/or a light-chain variable region, wherein the variable region has CDR(s) and/or FR(s), and wherein at least one amino acid residue selected from the group of modification sites identical to the modification sites in the group defined in [13] or [14] is modified in a CDR and/or a FR;

[A7] use of the antibody of any one of [1] to [23] and [A1] to [A6] in the manufacture of a medicament for promoting antigen elimination from plasma;

[A8] use of the antibody of any one of [1] to [23] and [A1] to [A6] in the manufacture of a medicament for increasing extracellular matrix binding;

[A9] use of the antibody of any one of [1] to [23] and [A1] to [A6] for eliminating an antigen from plasma; and

[A10] use of the antibody of any one of [1] to [23] and [A1] to [A6] for increasing extracellular matrix binding.

[A11] an antibody obtained by the method of any one of [30], [30A], [30B], [31], [32].

According to various embodiments, Disclosure A encompasses combinations of one or multiple elements described in any of [1] to [30], [30A], [30B], [31], [32] and [A1] to [A11] mentioned above, in part or as a whole, as long as such a combination is not technically inconsistent with the common technical knowledge in the art. For example, in some embodiments, Disclosure A encompasses a method for producing a modified antibody comprising an antigen-binding domain which promotes elimination of an antigen from plasma as compared to that before the antibody modification, wherein the method comprises:

(a) modifying at least one amino acid residue that may be exposed on the surface of an antibody, which is:
(I) in a position in a CDR or FR selected from the group consisting of: (a) position 1, 3, 5, 8, 10, 12, 13, 15, 16, 18, 19, 23, 25, 26, 39, 41, 42, 43, 44, 46, 68, 71, 72, 73, 75, 76, 77, 81, 82, 82a, 82b, 83, 84, 85, 86, 105, 108, 110, and 112 in a FR of the heavy chain variable region; (b) position 31, 61, 62, 63, 64, 65, and 97 in a CDR of the heavy chain variable region; (c) position 1, 3, 7, 8, 9, 11, 12, 16, 17, 18, 20, 22, 37, 38, 39, 41, 42, 43, 45, 46, 49, 57, 60, 63, 65, 66, 68, 69, 70, 74, 76, 77, 79, 80, 81, 85, 100, 103, 105, 106, 107, and 108 in a FR of the light chain variable region; and (d) position 24, 25, 26, 27, 52, 53, 54, 55, and 56 in a CDR of the light chain variable region, according to Kabat numbering; or
(II) in a position in a constant region selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering;
(b) modifying the antigen-binding domain in a way such that the resulting antigen-binding activity changes according to ion concentration conditions, wherein said (a) and (b) can be carried out simultaneously or sequentially;
(c) culturing a host cell to express the nucleic acid encoding the modified antibody; and
(d) collecting the modified antibody from the host cell culture.

In further embodiments, the method optionally further comprises any one or more of:
(e) selecting an antibody which can promote elimination of an antigen from plasma;

(f) selecting an antibody with enhanced binding activity to an extracellular matrix;

(g) selecting an antibody with enhanced FcγR-binding activity under a neutral pH condition (e.g., pH 7.4);

(h) selecting an antibody with enhanced FcγRIIb-binding activity under a neutral pH condition (e.g., pH 7.4);

(i) selecting an antibody with maintained or enhanced FcγRIIb-binding activity and decreased binding activity to one or more activating FcγR, preferably selected from the group consisting of FcγRIa, FcγRIb, FcγRIc, FcγRIIIa, FcγRIIIb and FcγRIIa;

(j) selecting an antibody with enhanced FcRn-binding activity under a neutral pH condition (e.g., pH 7.4);

(k) selecting an antibody with an increased isoelectric point (pI);

(l) confirming the isoelectric point (pI) of the collected antibody, and then selecting an antibody with an increased isoelectric point (pI); and (m) selecting an antibody whose antigen-binding activity is changed or increased according to ion concentration conditions;

as compared to the antibody before the modification.

Another embodiment of Disclosure A relates to, for example, without limitation:

[D1] a method for producing a modified antibody, whose half-life in plasma is prolonged or reduced, as compared to that before the modification of the antibody, wherein the method comprises:

(a) modifying a nucleic acid encoding the antibody before the modification to change the charge of at least one amino acid residue at a position selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering;

(b) culturing a host cell to express the nucleic acid; and (c) collecting the antibody from the host cell culture; or

[D2] a method for prolonging or reducing the half-life of an antibody in plasma wherein the method comprises modifying at least one amino acid residue at a position selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering.

In one embodiment, Disclosure B relates to, for example, without limitation:

[33] an Fc region variant comprising an FcRn-binding domain, wherein the FcRn-binding domain comprises Ala at position 434; Glu, Arg, Ser, or Lys at position 438; and Glu, Asp, or Gln at position 440, according to EU numbering;

[34] the Fc region variant of [33], wherein the FcRn-binding domain comprises Ala at position 434; Arg or Lys at position 438; and Glu or Asp at position 440, according to EU numbering;

[35] the Fc region variant of [33] or [34], wherein the FcRn-binding domain further comprises Ile or Leu at position 428; and/or Ile, Leu, Val, Thr, or Phe at position 436, according to EU numbering;

[36] the Fc region variant of [35], wherein the FcRn-binding domain comprises Leu at position 428; and/or Val or Thr at position 436, according to EU numbering;

[37] the Fc region variant of any one of [33] to [36], wherein the FcRn-binding domain comprises a combination of amino acid substitutions selected from the group consisting of: N434A/Q438R/S440E; N434A/Q438R/S440D; N434A/Q438K/S440E; N434A/Q438K/S440D; N434A/Y436T/Q438R/S440E; N434A/Y436T/Q438R/S440D; N434A/Y436T/Q438K/S440E; N434A/Y436T/Q438K/S440D; N434A/Y436V/Q438R/S440E; N434A/Y436V/Q438R/S440D; N434A/Y436V/Q438K/S440E; N434A/Y436V/Q438K/S440D; N434A/R435H/F436T/Q438R/S440E; N434A/R435H/F436T/Q438R/S440D; N434A/R435H/F436T/Q438K/S440E; N434A/R435H/F436T/Q438K/S440D; N434A/R435H/F436V/Q438R/S440E; N434A/R435H/F436V/Q438R/S440D; N434A/R435H/F436V/Q438K/S440E; N434A/R435H/F436V/Q438K/S440D; M428L/N434A/Q438R/S440E; M428L/N434A/Q438R/S440D; M428L/N434A/Q438K/S440E; M428L/N434A/Q438K/S440D; M428L/N434A/Y436T/Q438R/S440E; M428L/N434A/Y436T/Q438R/S440D; M428L/N434A/Y436T/Q438K/S440E; M428L/N434A/Y436T/Q438K/S440D; M428L/N434A/Y436V/Q438R/S440E; M428L/N434A/Y436V/Q438R/S440D; M428L/N434A/Y436V/Q438K/S440E; M428L/N434A/Y436V/Q438K/S440D; L235R/G236R/S239K/M428L/N434A/Y436T/Q438R/S440E; and L235R/G236R/A327G/A330S/P331S/M428L/N434A/Y436T/Q438R/S440E, according to EU numbering;

[38] the Fc region variant of [37], wherein the FcRn-binding domain comprises a combination of amino acid substitutions selected from the group consisting of: N434A/Q438R/S440E; N434A/Y436T/Q438R/S440E; N434A/Y436V/Q438R/S440E; M428L/N434A/Q438R/S440E; M428L/N434A/Y436T/Q438R/S440E; M428L/N434A/Y436V/Q438R/S440E; L235R/G236R/S239K/M428L/N434A/Y436T/Q438R/S440E; and L235R/G236R/A327G/A330S/P331S/M428L/N434A/Y436T/Q438R/S440E, according to EU numbering;

[39] the Fc region variant of any one of [33] to [38], wherein its FcRn-binding activity under an acidic pH condition (e.g., pH 5.8) is enhanced as compared to that of an Fc region of a native IgG;

[40] the Fc region variant of any one of [33] to [39], wherein its binding activity to an anti-drug antibody (ADA) is not significantly enhanced under a neutral pH condition as compared to that of an Fc region of a native IgG;

[41] the Fc region variant of [40], wherein the anti-drug antibody (ADA) is a rheumatoid factor (RF);

[42] the Fc region variant of any one of [33] to [41], wherein its plasma clearance (CL) is decreased, plasma retention time is increased, or plasma half-life (t1/2) is increased, as compared to that of an Fc region of a native IgG;

[43] the Fc region variant of any one of [33] to [42], wherein its plasma retention is increased as compared to a reference Fc region variant comprising a combination of amino acid substitutions N434Y/Y436V/Q438R/S440E, according to EU numbering;

[44] an antibody comprising the Fc region variant of any one of [33] to [43];

[45] the antibody of [44], wherein the antibody is an IgG antibody;

[46] a pharmaceutical composition comprising the antibody of [44] or [45];

[47] the pharmaceutical composition of [46], which is for increasing retention of the antibody in plasma;

[48] a nucleic acid encoding the Fc region variant of any one of [33] to [43] or the antibody of [44] or [45];

[49] a vector comprising the nucleic acid of [48];

[50] a host cell comprising the vector of [49];

[51] a method for producing an Fc region variant comprising an FcRn-binding domain or an antibody comprising the variant, which comprises culturing the host cell of [50], and then collecting the Fc region variant or the antibody comprising the variant from the cell culture;

[52] the method of [51], which further optionally comprises any one or more steps selected from the group consisting of:
  (a) selecting an Fc region variant with enhanced FcRn-binding activity under an acidic pH condition as compared to that of an Fc region of a native IgG;
  (b) selecting an Fc region variant whose binding activity to an anti-drug antibody (ADA) is not significantly enhanced under a neutral pH condition as compared to that of an Fc region of a native IgG;
  (c) selecting an Fc region variant with increased plasma retention as compared to that of an Fc region of a native IgG; and
  (d) selecting an antibody comprising an Fc region variant that can promote elimination of an antigen from plasma as compared to a reference antibody comprising an Fc region of a native IgG; and

[53] a method for producing an Fc region variant comprising an FcRn-binding domain or an antibody comprising the variant, wherein the method comprises substituting amino acids in a way such that the resulting Fc region variant or the antibody comprising the variant comprises Ala at position 434; Glu, Arg, Ser, or Lys at position 438; and Glu, Asp, or Gln at position 440, according to EU numbering.

In one embodiment, Disclosure B relates to, for example, without limitation:

[B1] use of the Fc region variant of any one of [33] to [43] or the antibody of [44] or [45] in the manufacture of a medicament for increasing retention in plasma;

[B2] use of the Fc region variant of any one of [33] to [43] or the antibody of [44] or [45] in the manufacture of a medicament for not significantly increasing the binding activity for an anti-drug antibody (ADA) under a neutral pH condition compared to the Fc region of a native IgG;

[B3] use of the Fc region variant of any one of [33] to [43] or the antibody of [44] or [45] for increasing retention in plasma;

[B4] use of the Fc region variant of any one of [33] to [43] or the antibody of [44] or [45] for not significantly increasing the binding activity for an anti-drug antibody (ADA) under a neutral pH condition compared to the Fc region of a native IgG; and

[B5] an Fc region variant or an antibody comprising the variant, which is obtained by the method of any one of [51], [52], and [53].

According to various embodiments, Disclosure B encompasses combinations of one or multiple elements described in any of [33] to [53] and [B1] to [B5] mentioned above, in part or as a whole, as long as such a combination is not technically inconsistent with the common technical knowledge in the art. For example, in some embodiments, Disclosure B encompasses an Fc region variant comprising an FcRn-binding domain, wherein the FcRn-binding domain can comprise:
  (a) Ala at position 434; Glu, Arg, Ser, or Lys at position 438; and Glu, Asp, or Gln at position 440, according to EU numbering;
  (b) Ala at position 434; Arg or Lys at position 438; and Glu or Asp at position 440, according to EU numbering;
  (c) Ile or Leu at position 428; Ala at position 434; Ile, Leu, Val, Thr, or Phe at position 436; Glu, Arg, Ser, or Lys at position 438; and Glu, Asp, or Gln at position 440, according to EU numbering;
  (d) Ile or Leu at position 428; Ala at position 434; Ile, Leu, Val, Thr, or Phe at position 436; Arg or Lys at position 438; and Glu or Asp at position 440, according to EU numbering;
  (e) Leu at position 428; Ala at position 434; Val or Thr at position 436; Glu, Arg, Ser, or Lys at position 438; and Glu, Asp, or Gln at position 440, according to EU numbering; or
  (f) Leu at position 428; Ala at position 434; Val or Thr at position 436; Arg or Lys at position 438; and Glu or Asp at position 440, according to EU numbering.

In one embodiment, Disclosure C relates to, for example, without limitation:

[54] an isolated anti-IL-8 antibody that binds to human IL-8, which comprises at least one amino acid substitution(s) in at least one of (a) to (f) below, and binds to IL-8 in a pH-dependent manner:
  (a) HVR-H1 comprising the amino acid sequence of SEQ ID NO:67;
  (b) HVR-H2 comprising the amino acid sequence of SEQ ID NO:68;
  (c) HVR-H3 comprising the amino acid sequence of SEQ ID NO:69;
  (d) HVR-L1 comprising the amino acid sequence of SEQ ID NO:70;
  (e) HVR-L2 comprising the amino acid sequence of SEQ ID NO:71; and
  (f) HVR-L3 comprising the amino acid sequence of SEQ ID NO:72;

[55] the anti-IL-8 antibody of [54], which comprises an amino acid substitutions of tyrosine at position 9 of the amino acid sequence of SEQ ID NO:68, arginine at position 11 of the amino acid sequence of SEQ ID NO:68, and tyrosine at position 3 of the amino acid sequence of SEQ ID NO:69;

[56] the anti-IL-8 antibody of [54] or [55], which further comprises an amino acid substitutions of alanine at position 6 of the amino acid sequence of SEQ ID NO:68 and glycine at position 8 of the amino acid sequence of SEQ ID NO:68;

[57] the anti-IL-8 antibody of any one of [54] to [56], which comprises an amino acid substitutions of asparagine at position 1 of the amino acid sequence of SEQ ID NO:71, leucine at position 5 of the amino acid sequence of SEQ ID NO:71, and glutamine at position 1 of the amino acid sequence of SEQ ID NO:72;

[58] the anti-IL-8 antibody of any one of [54] to [57], which comprises (a) HVR-H1 comprising the amino acid sequence of SEQ ID NO:67, (b) HVR-H2 comprising the amino acid sequence of SEQ ID NO:73, and (c) HVR-H3 comprising the amino acid sequence of SEQ ID NO:74;

[59] the anti-IL-8 antibody of any one of [54] to [58], which comprises (a) HVR-L1 comprising the amino acid sequence of SEQ ID NO:70, (b) HVR-L2 comprising the amino acid sequence of SEQ ID NO:75, and (c) HVR-L3 comprising the amino acid sequence of SEQ ID NO:76;

[60] the anti-IL-8 antibody of any one of [54] to [59], which comprises the heavy chain variable region of SEQ ID NO:78 and the light chain variable region of SEQ ID NO:79;

[61] the anti-IL-8 antibody of any one of [54] to [60], which comprises an Fc region having at least one property selected from the properties of (a) to (f) below:

(a) increased binding affinity for FcRn of the Fc region relative to the binding affinity for FcRn of a native Fc region at acidic pH;
(b) reduced binding affinity of the Fc region for pre-existing ADA relative to the binding affinity of a native Fc region for the pre-existing ADA;
(c) increased plasma half-life of the Fc region relative to the plasma half-life of a native Fc region;
(d) reduced plasma clearance of the Fc region relative to the plasma clearance of a native Fc region; and
(e) reduced binding affinity of the Fc region for an effector receptor relative to the binding affinity of a native Fc region for the effector receptor; and
(f) increased binding to extracellular matrix.

[62] the anti-IL-8 antibody of [61], wherein the Fc region comprises amino acid substitution(s) at one or more positions selected from the group consisting of position 235, 236, 239, 327, 330, 331, 428, 434, 436, 438 and 440, according to EU numbering;

[63] the anti-IL-8 antibody of [62], which comprises an Fc region comprising one or more amino acid substitutions selected from the group consisting of L235R, G236R, S239K, A327G, A330S, P331S, M428L, N434A, Y436T, Q438R and S440E;

[64] the anti-IL-8 antibody of [63], wherein the Fc region comprises the amino acid substitutions of L235R, G236R, S239K, M428L, N434A, Y436T, Q438R and S440E;

[65] the anti-IL-8 antibody of [63], wherein the Fc region comprises the amino acid substitution of L235R, G236R, A327G, A330S, P331S, M428L, N434A, Y436T, Q438R and S440E;

[66] an anti-IL-8 antibody that comprises a heavy chain comprising the amino acid sequence of SEQ ID NO:81 and a light chain comprising the amino acid sequence of SEQ ID NO:82;

[67] an anti-IL-8 antibody that comprises a heavy chain comprising the amino acid sequence of SEQ ID NO:80 and a light chain comprising the amino acid sequence of SEQ ID NO:82;

[68] an isolated nucleic acid encoding the anti-IL-8 antibody of any one of [54] to [67];

[69] a vector comprising the nucleic acid of [68];

[70] a host cell comprising the vector of [69];

[71] a method for producing an anti-IL-8 antibody, which comprises culturing the host of [70];

[72] the method for producing an anti-IL-8 antibody of [71], which comprises isolating the antibody from a culture supernatant;

[73] a pharmaceutical composition comprising the anti-IL-8 antibody of any one of
[54] to [67], and a pharmaceutically acceptable carrier;

[74] the anti-IL-8 antibody of any one of [54] to [67] for use in a pharmaceutical composition;

[75] the anti-IL-8 antibody of any one of [54] to [67] for use in the treatment of a disorder with the presence of excess IL-8;

[76] use of the anti-IL-8 antibody of any one of [54] to [67] in the manufacture of a pharmaceutical composition for a disorder with the presence of excess IL-8;

[77] a method for treating a patient that has a disorder with the presence of excess IL-8, which comprises administering the anti-IL-8 antibody of any one of [54] to [67] to the individual;

[78] a method for promoting elimination of IL-8 from an individual, which comprises administering the anti-IL-8 antibody of any one of [54] to [67] to the individual;

[79] a pharmaceutical composition comprising the anti-IL-8 antibody of any one of [54] to [67], wherein the antibody binds to IL-8 and binds to extracellular matrix; and

[80] a method for producing an anti-IL-8 antibody comprising a variable region with a pH-dependent IL-8-binding activity, wherein the method comprises:
(a) evaluating binding of an anti-IL-8 antibody with extracellular matrix,
(b) selecting an anti-IL-8 antibody with strong binding to the extracellular matrix,
(c) culturing a host that comprises a vector comprising a nucleic acid encoding the antibody, and
(d) isolating the antibody from the culture solution.

In an alternative embodiment, Disclosure C relates to:

[C1] use of the anti-IL-8 antibody of any one of [54] to [67] and [C26] to [C31] in the manufacture of a pharmaceutical composition for suppressing accumulation of IL-8 which has a biological activity;

[C2] use of the anti-IL-8 antibody of any one of [54] to [67] and [C26] to [C31] for suppressing accumulation of IL-8 which has a biological activity;

[C3] use of the anti-IL-8 antibody of any one of [54] to [67] and [C26] to [C31] in the manufacture of a pharmaceutical composition for inhibiting angiogenesis;

[C4] use of the anti-IL-8 antibody of any one of [54] to [67] and [C26] to [C31] for inhibiting angiogenesis;

[C5] use of the anti-IL-8 antibody of any one of [54] to [67] and [C26] to [C31] in the manufacture of a pharmaceutical composition for inhibiting facilitation of neutrophil migration;

[C6] use of the anti-IL-8 antibody of any one of [54] to [67] and [C26] to [C31] for inhibiting facilitation of neutrophil migration;

[C7] the anti-IL-8 antibody of any one of [54] to [67] and [C26] to [C31] for use in suppressing accumulation of IL-8 which has a biological activity;

[C8] a method for suppressing accumulation of IL-8 which has a biological activity, wherein the method comprises administering the anti-IL-8 antibody of any one of [54] to [67] and [C26] to [C31] to an individual;

[C9] a pharmaceutical composition for suppressing accumulation of IL-8 which has a biological activity, comprising the anti-IL-8 antibody of any one of [54] to [67] and [C26] to [C31];

[C10] the anti-IL-8 antibody of any one of [54] to [67] and [C26] to [C31] for use in inhibiting angiogenesis;

[C11] a method for inhibiting angiogenesis in an individual, wherein the method comprises administering the anti-IL-8 antibody of any one of [54] to [67] and [C26] to [C31] to the individual;

[C12] a pharmaceutical composition for inhibiting angiogenesis, which comprises the anti-IL-8 antibody of any one of [54] to [67] and [C26] to [C31];

[C13] the anti-IL-8 antibody of any one of [54] to [67] and [C26] to [C31] for use in inhibiting facilitation of neutrophil migration;

[C14] a method for inhibiting facilitation of neutrophil migration in an individual, wherein the method comprises administering the anti-IL-8 antibody of any one of [54] to [67] and [C26] to [C31] to the individual;

[C15] a pharmaceutical composition for inhibiting facilitation of neutrophil migration, which comprises the anti-IL-8 antibody of any one of [54] to [67] and [C26] to [C31];

[C16] the anti-IL-8 antibody of any one of [54] to [67] and [C26] to [C31] for use in the treatment of a disorder with the presence of excess IL-8;

[C17] use of the anti-IL-8 antibody of any one of [54] to [67] and [C26] to [C31] in the manufacture of a pharmaceutical composition for treating a disorder with the presence of excess IL-8;

[C18] use of the anti-IL-8 antibody of any one of [54] to [67] and [C26] to [C31] for treating a disorder with the presence of excess IL-8;

[C19] a method for treating a disorder with the presence of excess IL-8 in an individual, wherein the method comprises administering the anti-IL-8 antibody of any one of [54] to [67] and [C26] to [C31] to the individual;

[C20] a pharmaceutical composition for treating a disorder with the presence of excess IL-8, which comprises the anti-IL-8 antibody of any one of [54] to [67] and [C26] to [C31];

[C21] the anti-IL-8 antibody of any one of [54] to [67] and [C26] to [C31] for use in promoting elimination of IL-8;

[C22] use of the anti-IL-8 antibody of any one of [54] to [67] and [C26] to [C31] in the manufacture of a pharmaceutical composition for promoting elimination of IL-8;

[C23] use of the anti-IL-8 antibody of any one of [54] to [67] and [C26] to [C31] for promoting elimination of IL-8;

[C24] a method for promoting elimination of IL-8 in an individual, wherein the method comprises administering the anti-IL-8 antibody of any one of [54] to [67] and [C26] to [C31] to the individual; and

[C25] a pharmaceutical composition for promoting elimination of IL-8, which comprises the anti-IL-8 antibody of any one of [54] to [67] and [C26] to [C31].

[C26] An anti-IL-8 antibody, which comprises an Fc region comprising amino acid substitution(s) at one or more positions selected from the group consisting of position 235, 236, 239, 327, 330, 331, 428, 434, 436, 438 and 440, according to EU numbering.

[C27] The anti-IL-8 antibody of [C26], which comprises an Fc region having at least one property selected from the properties of (a) to (f) below:
  (a) increased binding affinity for FcRn of the Fc region relative to the binding affinity for FcRn of a native Fc region at acidic pH;
  (b) reduced binding affinity of the Fc region for pre-existing ADA relative to the binding affinity of a native Fc region for the pre-existing ADA;
  (c) increased plasma half-life of the Fc region relative to the plasma half-life of a native Fc region;
  (d) reduced plasma clearance of the Fc region relative to the plasma clearance of a native Fc region;
  (e) reduced binding affinity of the Fc region for an effector receptor relative to the binding affinity of a native Fc region for the effector receptor; and
  (f) increased binding to extracellular matrix.

[C28] The anti-IL-8 antibody of [C26] or [C27], which comprises an Fc region comprising one or more amino acid substitution(s) selected from the group consisting of L235R, G236R, S239K, A327G, A330S, P331S, M428L, N434A, Y436T, Q438R and S440E, according to EU numbering.

[C29] The anti-IL-8 antibody of [C28], which comprises an Fc region comprising one or more amino acid substitutions selected from the group consisting of (a) L235R, G236R, S239K, M428L, N434A, Y436T, Q438R and S440E; or (b) L235R, G236R, A327G, A330S, P331S, M428L, N434A, Y436T, Q438R and S440E, according to EU numbering.

[C30] The anti-IL-8 antibody of [C26] that comprises a heavy chain comprising the amino acid sequence of SEQ ID NO:81 and a light chain comprising the amino acid sequence of SEQ ID NO:82.

[C31] The anti-IL-8 antibody of [C26] that comprises a heavy chain comprising the amino acid sequence of SEQ ID NO:80 and a light chain comprising the amino acid sequence of SEQ ID NO:82.

[C32] An isolated nucleic acid encoding the anti-IL-8 antibody of any one of [C26] to [C31].

[C33] A vector comprising the nucleic acid of [C32].

[C34] A host cell comprising the vector of [C33].

[C35] A method for producing an anti-IL-8 antibody, which comprises culturing the host cell of [C34].

[C36] The method for producing an anti-IL-8 antibody of any one of [C26] to [C31], which further comprises isolating the antibody from the host cell culture.

[C37] A pharmaceutical composition comprising the anti-IL-8 antibody of any one of [C26] to [C31] and a pharmaceutically acceptable carrier.

[C38] A method for treating a patient that has a disorder with the presence of excess IL-8, which comprises administering the anti-IL-8 antibody of any one of [C26] to [C31] to the individual.

[C39] A method for promoting elimination of IL-8 from an individual, which comprises administering the anti-IL-8 antibody of any one of [C26] to [C31] to the individual.

[C40] A method for inhibiting IL-8, wherein the method comprises contacting the anti-IL-8 antibody of any one of [54] to [67] and [C26] to [C31] with IL-8.

[C41] The method of [C40], wherein the method inhibits a biological activity of IL-8.

According to various embodiments, Disclosure C encompasses combinations of one or multiple elements described in any of [54] to [80] and [C1] to [C41] mentioned above, in part or as a whole, as long as such a combination is not technically inconsistent with the common technical knowledge in the art.

BRIEF DESCRIPTION OF THE DRAWINGS/FIGURES

FIG. 1 shows changes in the plasma concentration of human IL-6 receptor in human FcRn transgenic mice administered with a human IL-6 receptor-binding antibody that binds to human IL-6 receptor in a pH-dependent manner and whose constant region is that of a native IgG1 (Low_pI-IgG1), or an antibody that has increased the pI of the variable region in the antibody (High_pI-IgG1).

FIG. 2 shows changes in the plasma concentration of human IL-6 receptor in human FcRn transgenic mice administered individually with a human IL-6 receptor-binding antibody that binds to human IL-6 receptor in a pH-dependent manner and has been conferred with binding to FcRn under a neutral pH condition (Low_pI-F939), and antibodies that have increased the pI of the variable region in the antibody (Middle_pI-F939, High_pI-F939).

FIG. 3 shows changes in the plasma concentration of human IL-6 receptor in human FcRn transgenic mice administered individually with a human IL-6 receptor-binding antibody that binds to human IL-6 receptor in a pH-dependent manner and whose FcγR binding under a neutral pH condition is increased (Low_pI-F1180), and antibodies that have increased the pI of the variable region in the antibody (Middle_pI-F1180, High_pI-F1180).

FIG. 4 shows changes in the plasma concentration of human IL-6 receptor in human FcRn transgenic mice whose soluble human IL-6 receptor concentration in plasma is maintained at a steady state, which have been administered individually with a human IL-6 receptor-binding antibody that binds to human IL-6 receptor in a pH-dependent manner and whose constant region is that of a native IgG1 (Low_pI-IgG1), an antibody that comprises an Fc region variant in which the Fc region in the antibody has increased FcRn binding under a neutral pH condition (Low_pI-F11), and antibodies that have increased the pI of the variable region in these antibodies (High_pI-IgG1, High_pI-F11).

FIG. 5 shows the extent of extracellular matrix binding of each of the three types of antibodies with different pIs that bind to human IL-6 receptor in a pH-dependent manner (Low_pI-IgG1, Middle_pI-IgG1 and High_pI-IgG1) and the two types of antibodies with different pIs that do not bind to human IL-6 receptor in a pH-dependent manner (Low_pI (NPH)-IgG1 and High_pI(NPH)-IgG1). "NPH" means pH independent within the scope of Disclosure A described herein.

Figure 19:
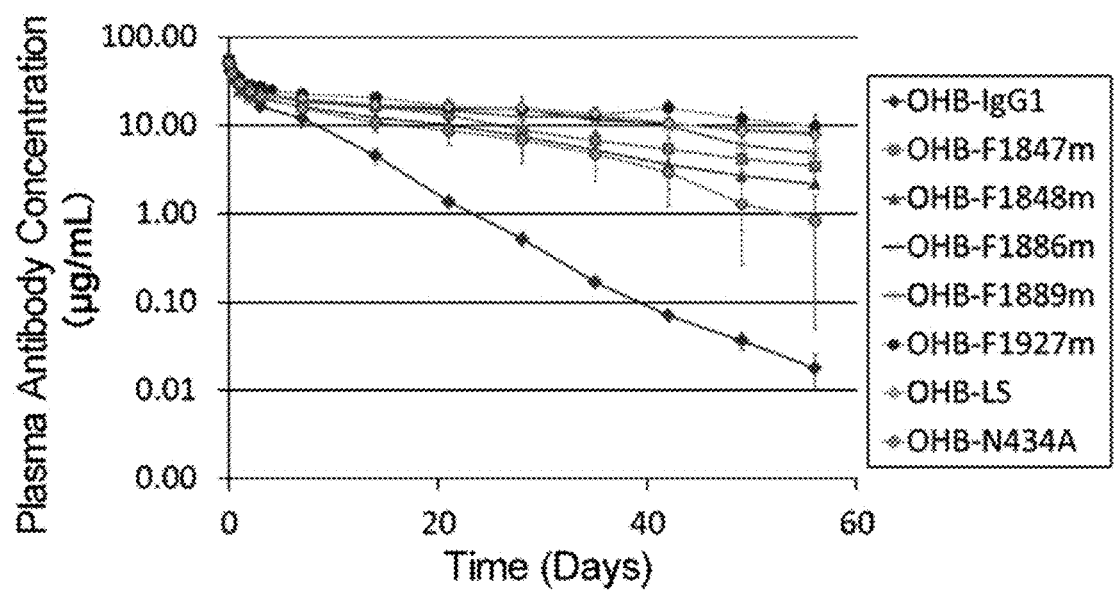

FIG. 19 shows changes in the plasma concentration of each anti-human IgE antibody in cynomolgus when administered with OHB-IgG1 which is an anti-human IgE antibody and has the Fc region of a native human IgG1, and each of the antibodies comprising a novel Fc region variant in which each the Fc region has an Fc region variant with increased binding to FcRn (OHB-LS, OHB-N434A, OHB-F1847m, OHB-F1848m, OHB-F1886m, OHB-F1889m and OHB-F1927m).

Figure 20:
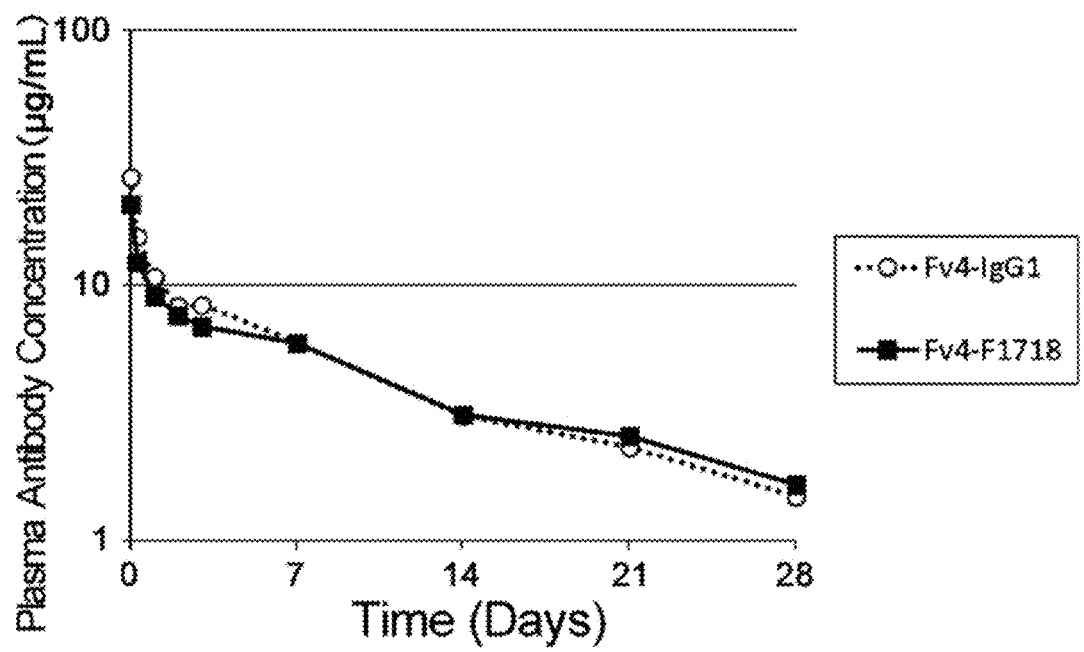

FIG. 20 shows changes in the plasma concentration of an anti-human IL-6 receptor antibody in human FcRn transgenic mouse when administered with Fv4-IgG1 which is an anti-human IL-6 receptor antibody and has the Fc region of a native human IgG1, or Fv4-F1718 which has increased FcRn binding of the antibody at the acidic pH condition.

Figure 21:
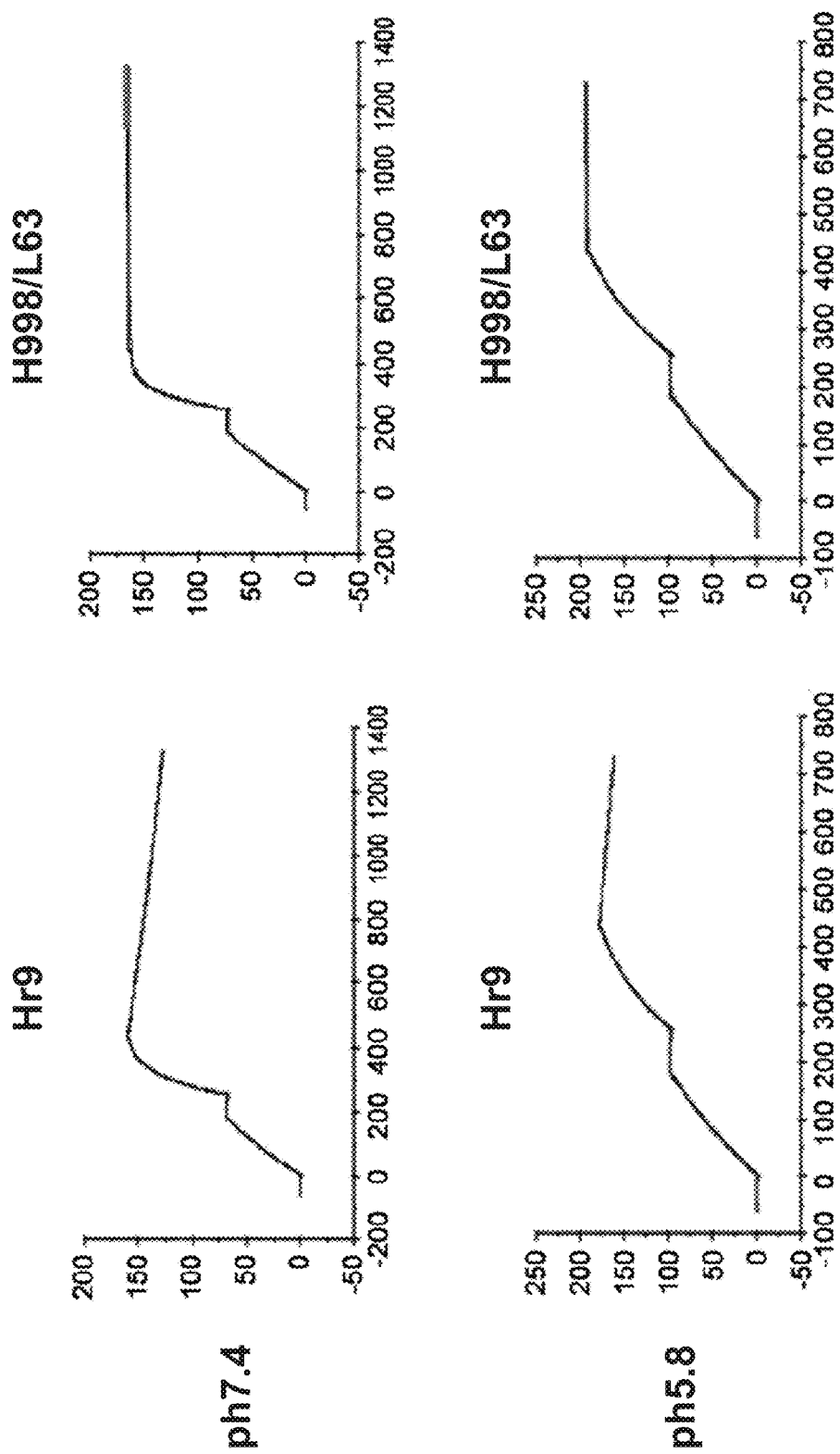

FIG. 21 shows sensorgrams obtained for IL-8 binding of H998/L63 and Hr9 at pH 7.4 and pH 5.8 measured with Biacore.

Figure 22:
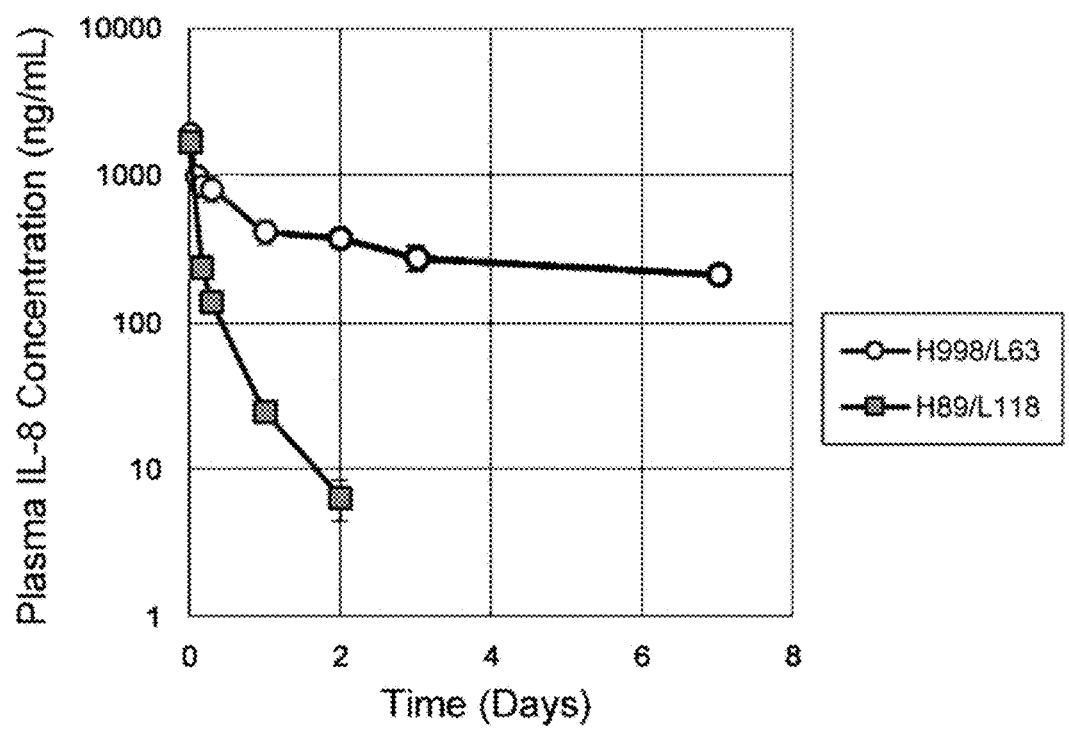

FIG. 22 shows changes of the human IL-8 concentration in mouse plasma when H998/L63 or H89/L118 was administered to mice at 2 mg/kg in a mixture with human IL-8.

Figure 23:
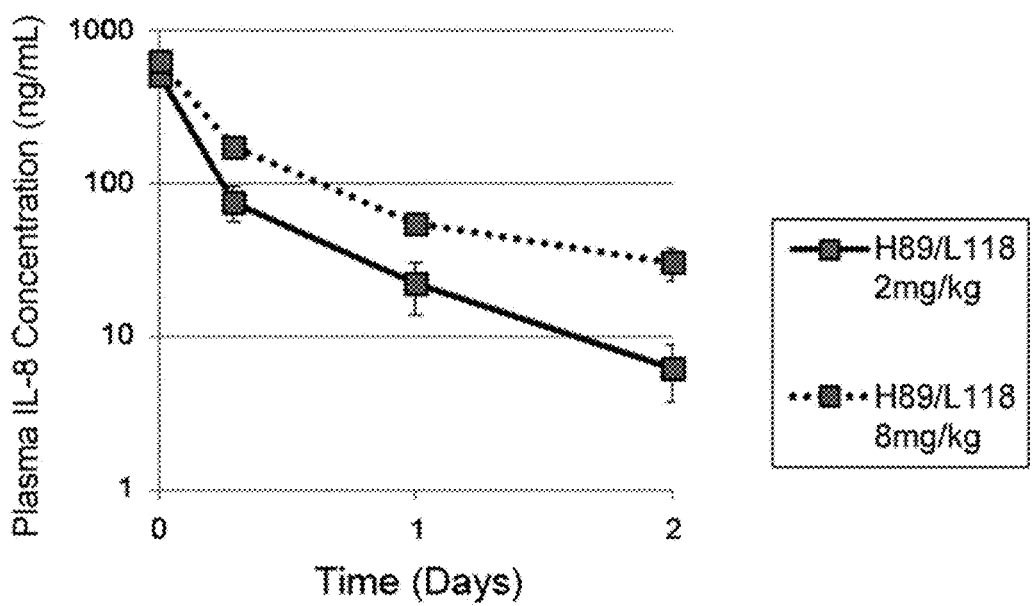

FIG. 23 shows changes of the human IL-8 concentration in mouse plasma when H89/L118 was administered to mice at 2 mg/kg or 8 mg/kg in a mixture with human IL-8.

Figure 24:
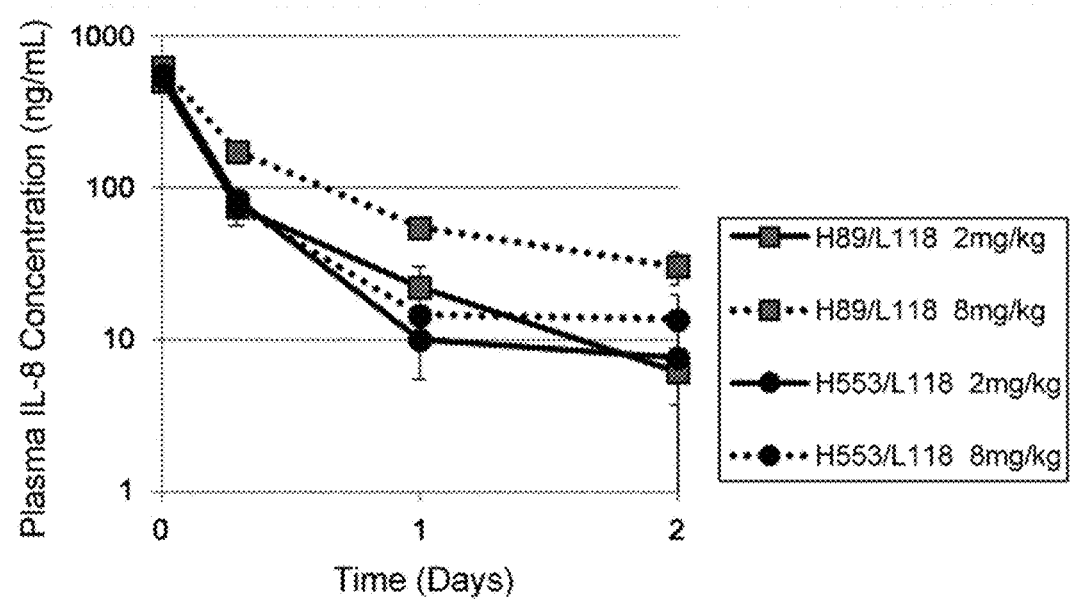

FIG. 24 shows changes of the human IL-8 concentration in mouse plasma when H89/L118 or H553/L118 was administered to mice at 2 mg/kg or 8 mg/kg in a mixture with human IL-8.

Figure 25A:
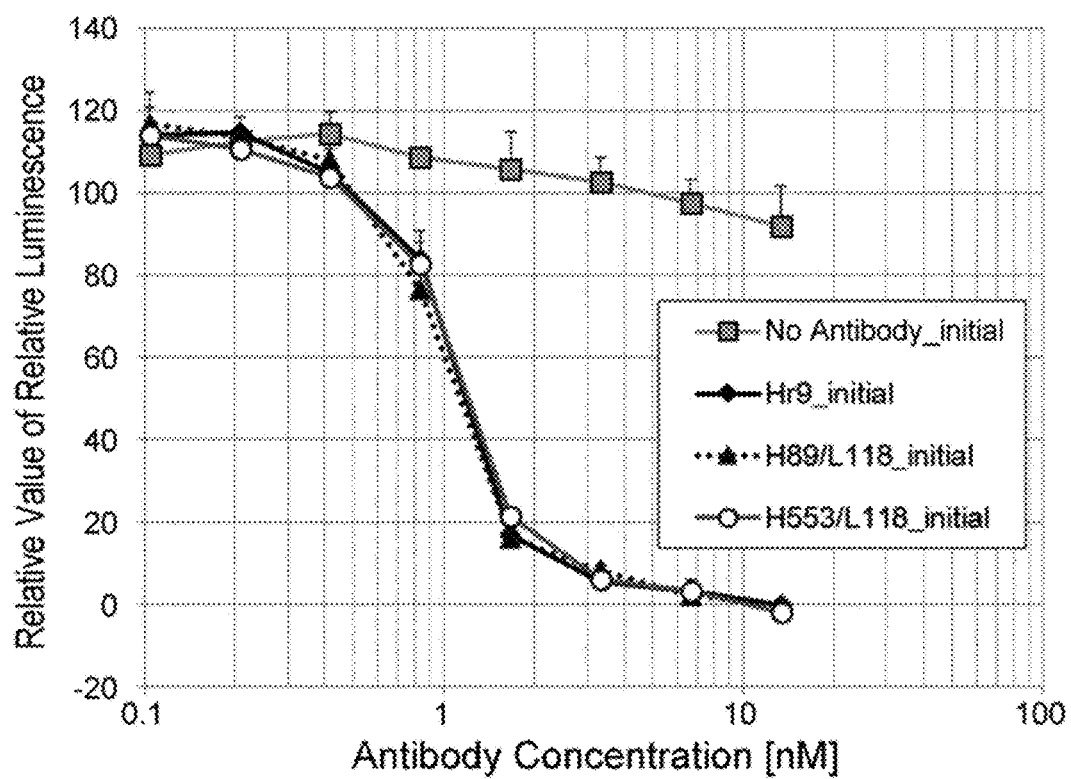

FIG. 25A shows changes in the relative values of antibody concentration-dependent chemiluminescence with antibody Hr9, H89/L118 or H553/L118 before preservation in plasma.

Figure 25B:
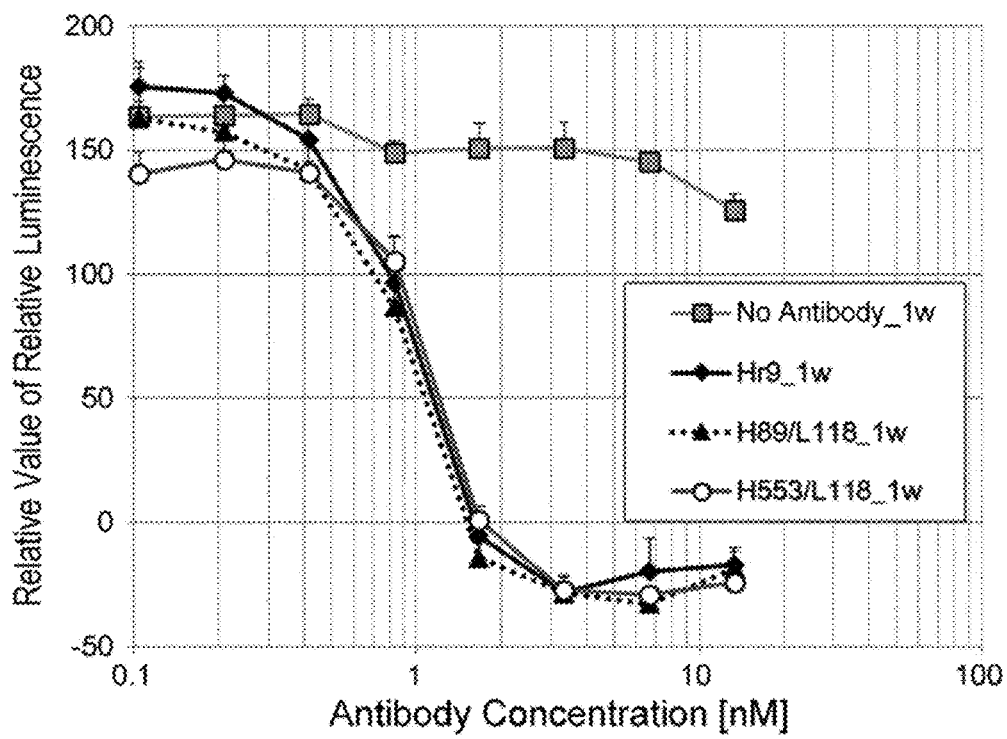

FIG. 25B shows changes in the relative values of antibody concentration-dependent chemiluminescence with antibody Hr9, H89/L118 or H553/L118 after one week of preservation in plasma.

Figure 25C:
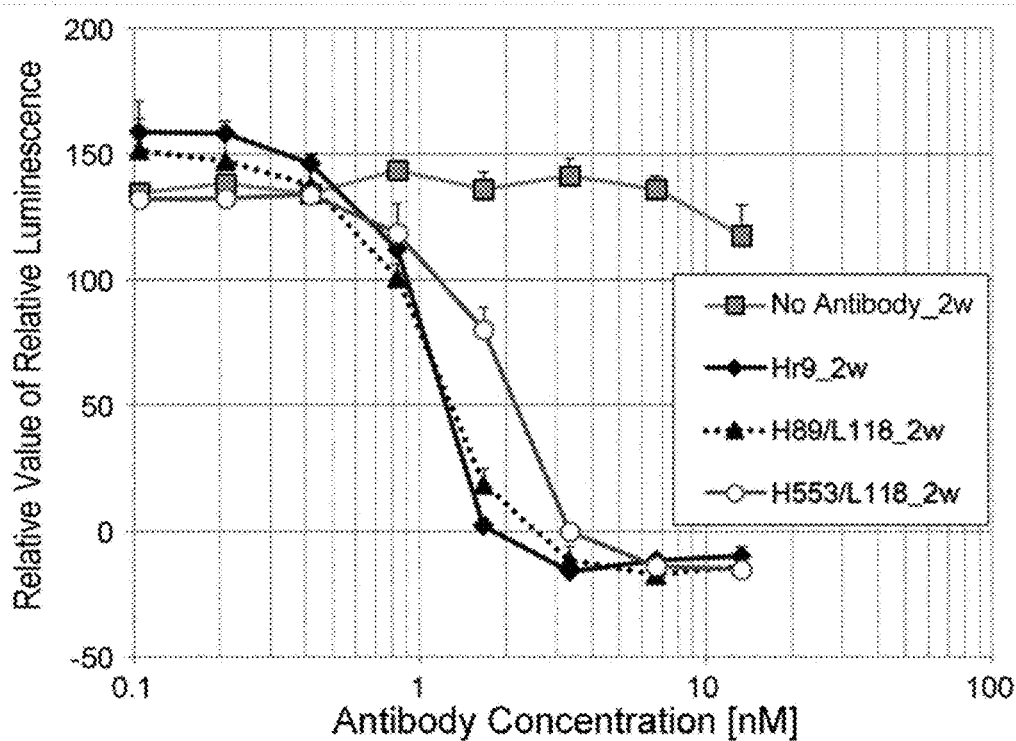

FIG. 25C shows changes in the relative values of antibody concentration-dependent chemiluminescence with antibody Hr9, H89/L118 or H553/L118 after two weeks of preservation in plasma.

Figure 26:
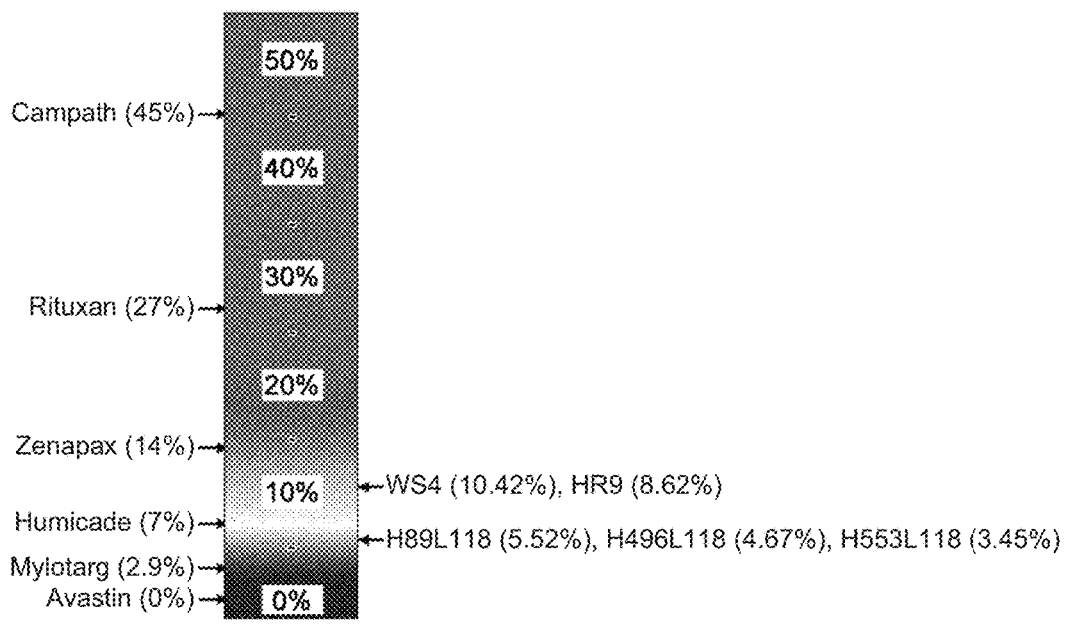

FIG. 26 shows the predicted frequency of ADA occurrence for each anti-IL-8 antibody (hWS4, Hr9, H89/L118, H496/L118 or H553/L118) and the predicted frequency of ADA occurrence for other pre-existing therapeutic antibodies predicted by the EpiMatrix.

Figure 27:
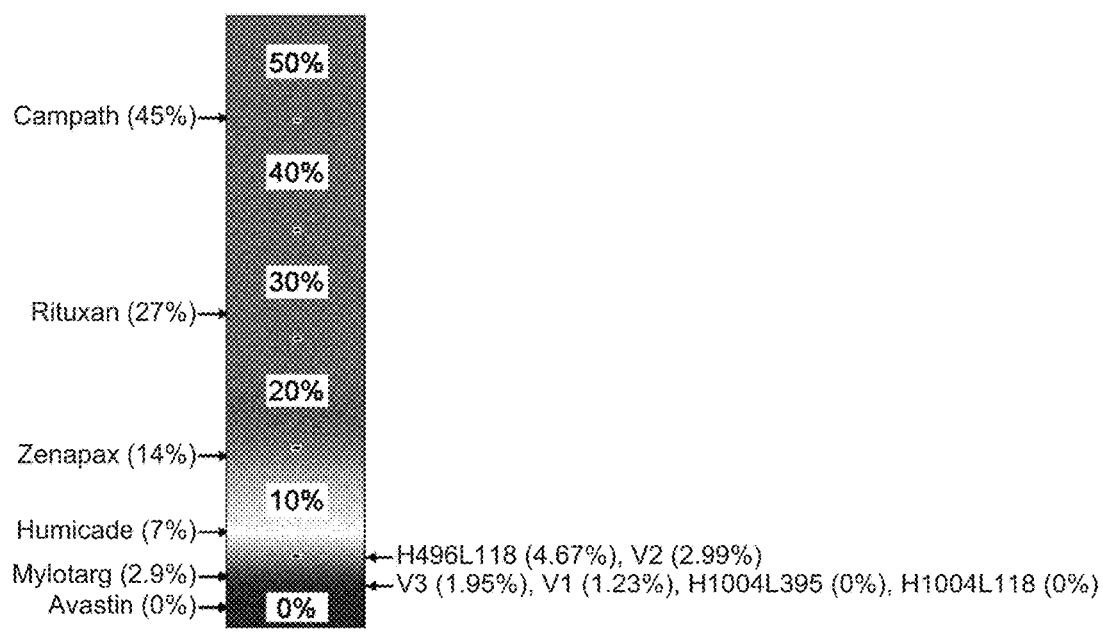

FIG. 27 shows the predicted frequency of ADA occurrence for each anti-IL-8 antibody (H496/L118, H496v1/L118, H496v2/L118, H496v3/L118, H1004/L118 or H1004/L395) and the predicted frequency of ADA occurrence for other pre-existing therapeutic antibodies predicted by EpiMatrix.

Figure 28A:
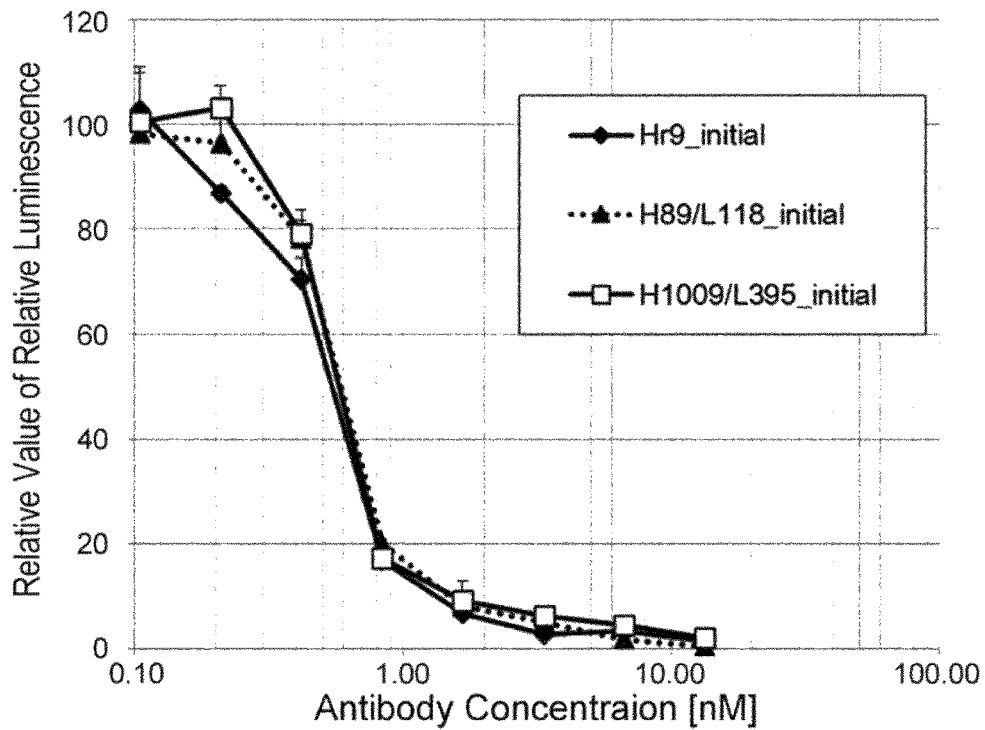

FIG. 28A shows changes in the relative values of antibody concentration-dependent chemiluminescence with antibody Hr9, H89/L118 or H1009/L395-F1886s before preservation in plasma.

Figure 28B:
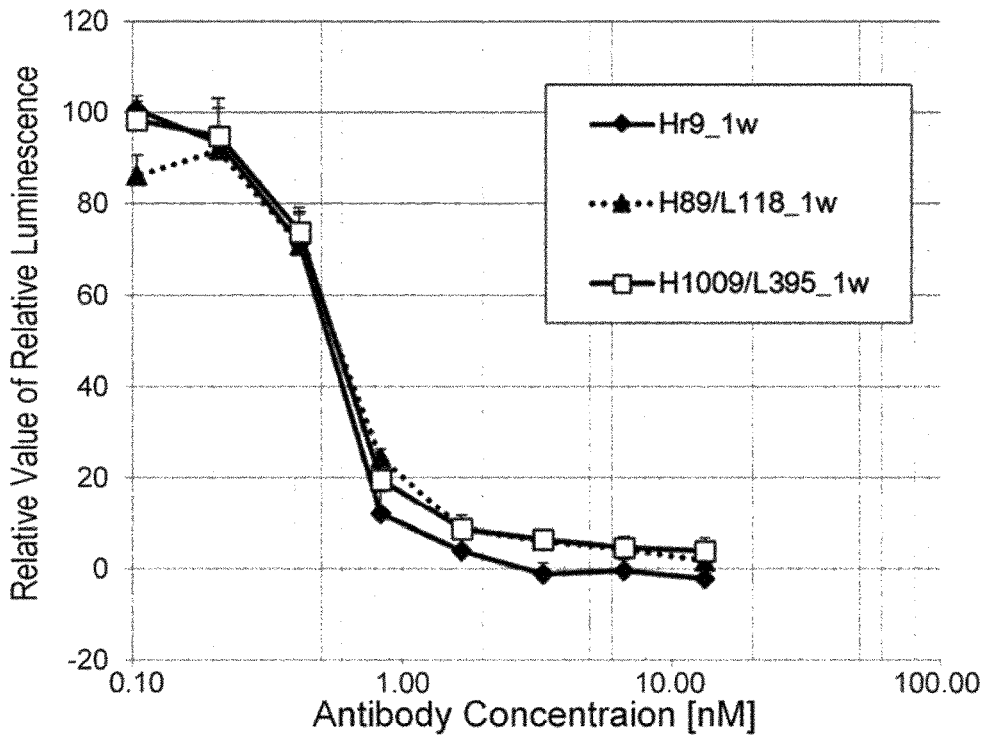

FIG. 28B shows changes in the relative values of antibody concentration-dependent chemiluminescence with antibody Hr9, H89/L118 or H1009/L395-F1886s after one week of preservation in plasma.

Figure 28C:
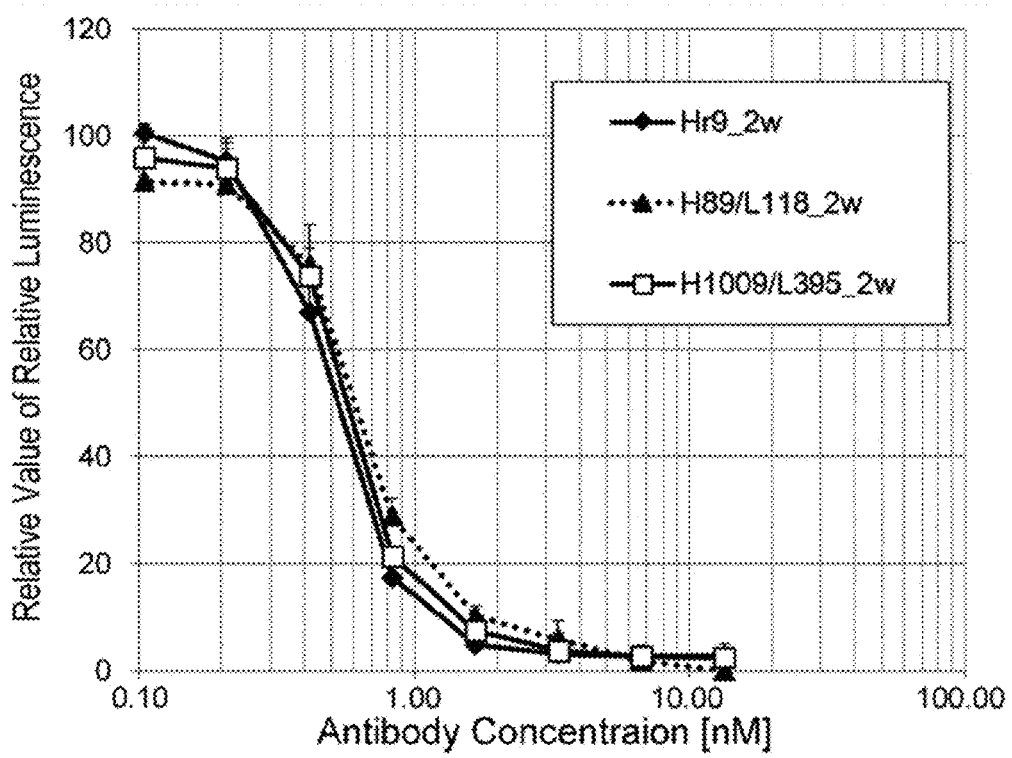

FIG. 28C shows changes in the relative values of antibody concentration-dependent chemiluminescence with antibody Hr9, H89/L118 or H1009/L395-F1886s after two weeks of preservation in plasma.

Figure 29:
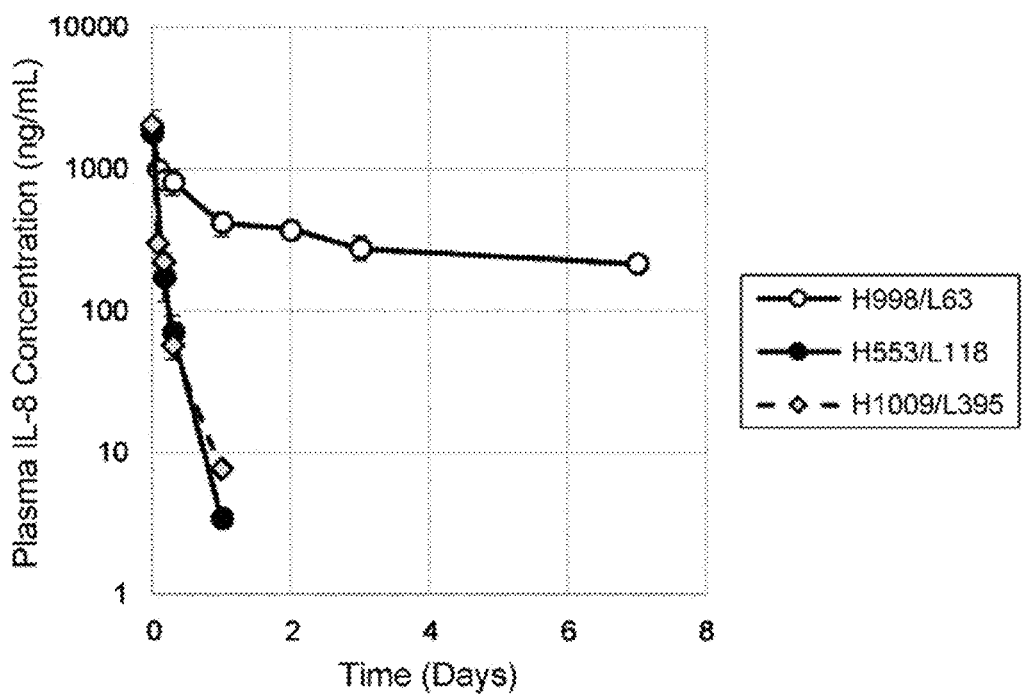

FIG. 29 shows changes of the human IL-8 concentration in mouse plasma when mice were administered with each of H1009/L395, H553/L118 and H998/L63 in a mixture with human IL-8.

Figure 30:
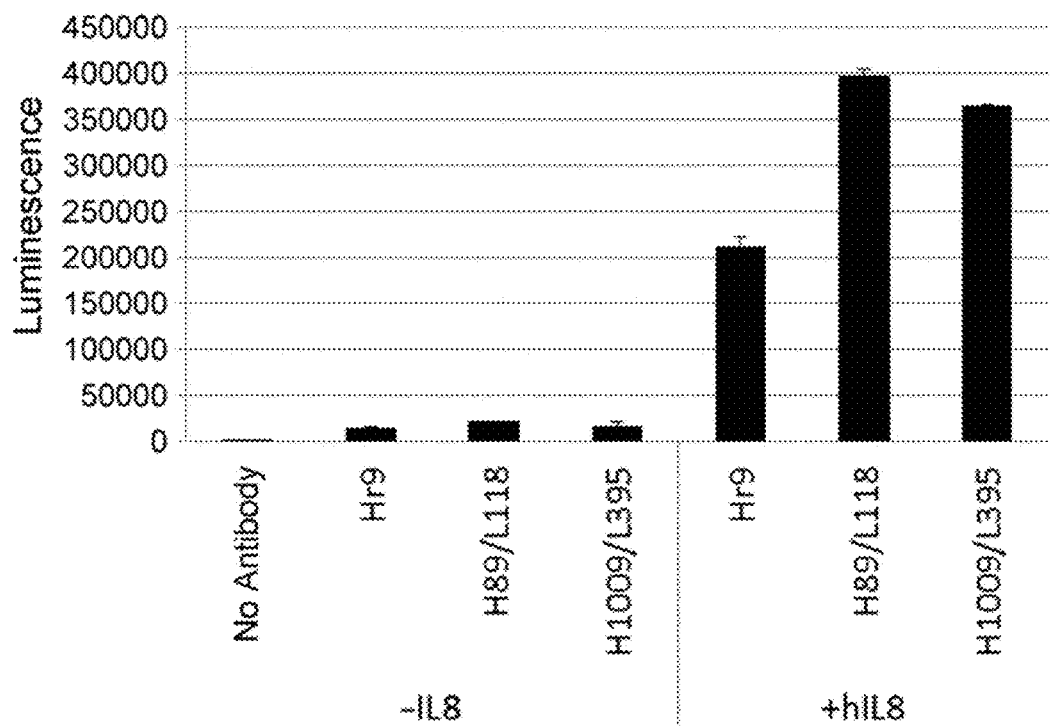

FIG. 30 shows the extent of extracellular matrix binding when Hr9, H89/L118 or H1009/L395 was added alone to extracellular matrix, and when they were added in a mixture with human IL-8.

Figure 31:
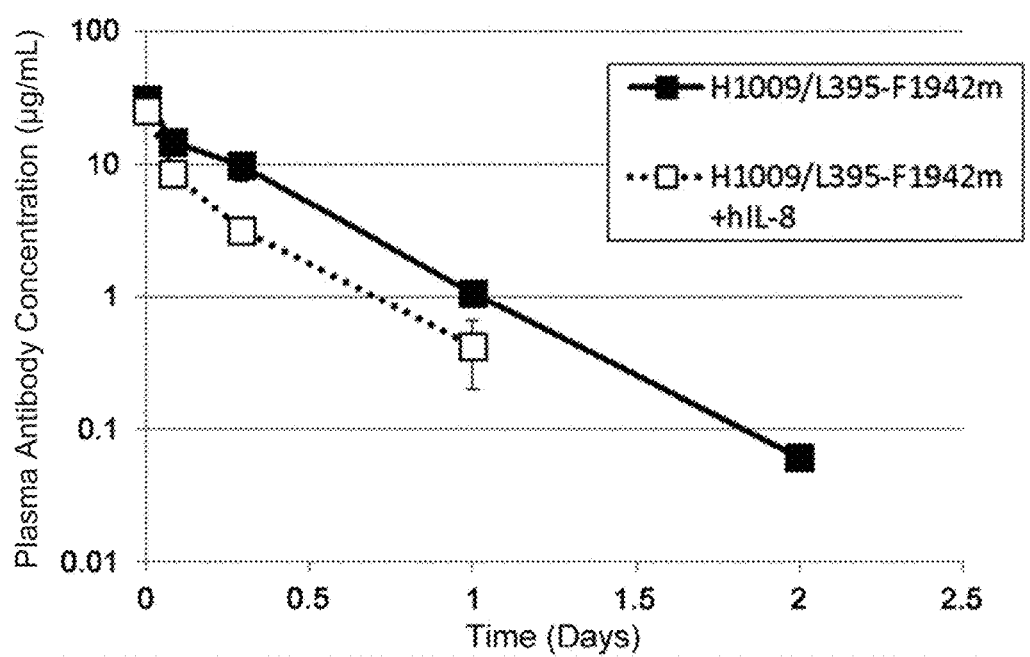

FIG. 31 shows changes of antibody concentration in mouse plasma when an antibody that has the variable region of H1009/L395 and the Fc region that does not bind to FcRn (F1942m) was administered alone or in a mixture with human IL-8 to human FcRn transgenic mice.

Figure 32:
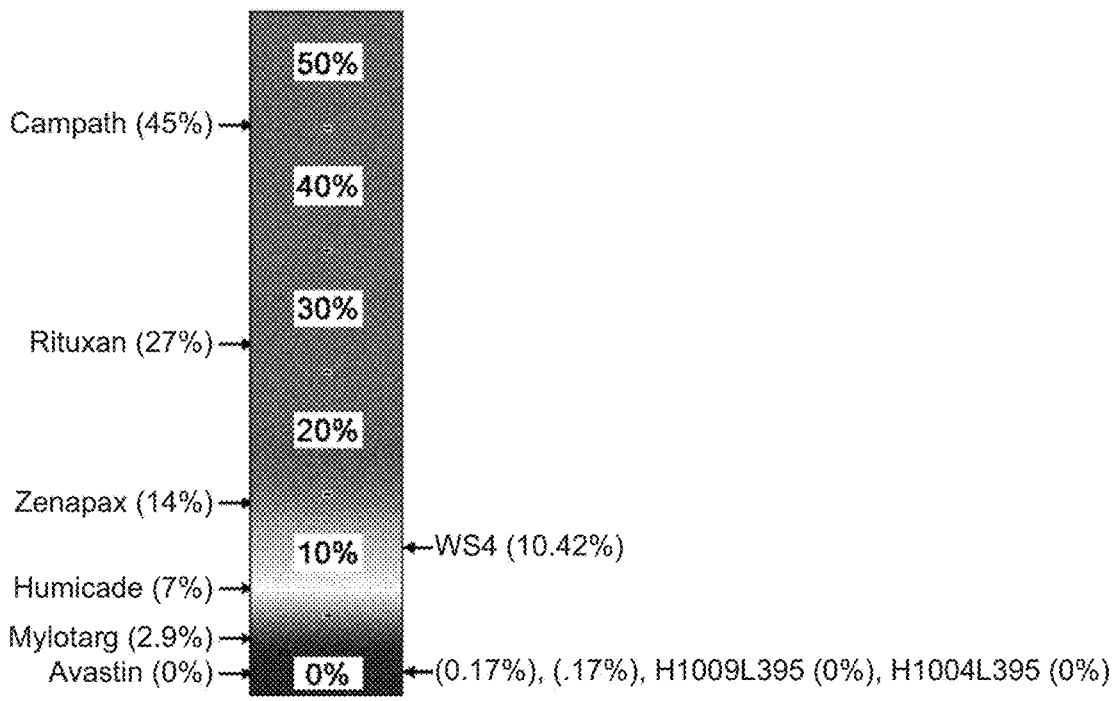

FIG. 32 shows the predicted frequency of ADA occurrence for H1009/L395 and H1004/L395 and the predicted frequency of ADA occurrence for other pre-existing therapeutic antibodies predicted by EpiMatrix.

Figure 33:
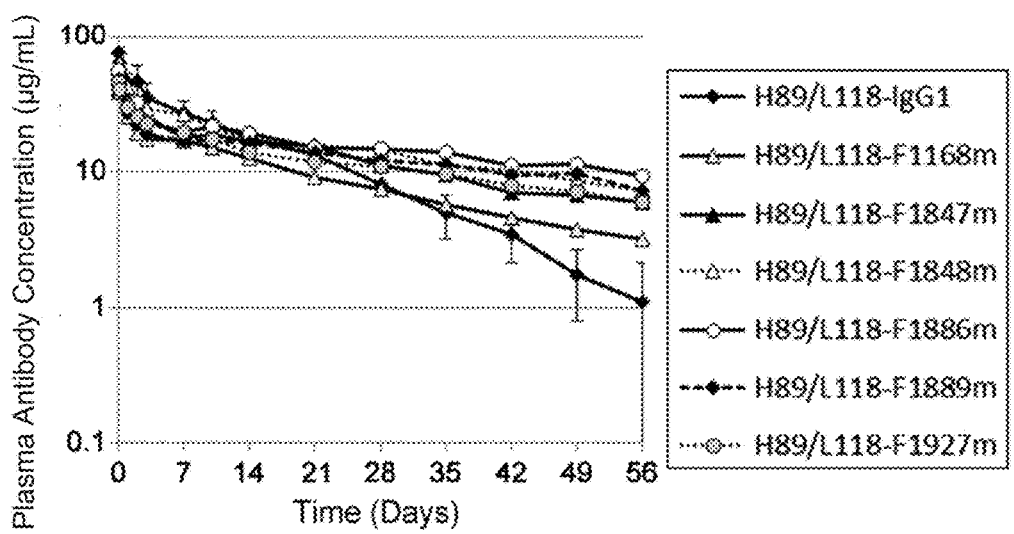

FIG. 33 shows changes in the concentration of the respective anti-human IL-8 antibody in the plasma of cynomolgus when administered with H89/L118-IgG1, which has the variable region of H89/L118 and the Fc region of a native human IgG1, and each antibody that has an Fc region variant with increased binding to FcRn (H89/L118-F1168m, H89/L118-F1847m, H89/L118-F1848m, H89/L118-F1886m, H89/L118-F1889m and H89/L118-F1927m).

Figure 34:
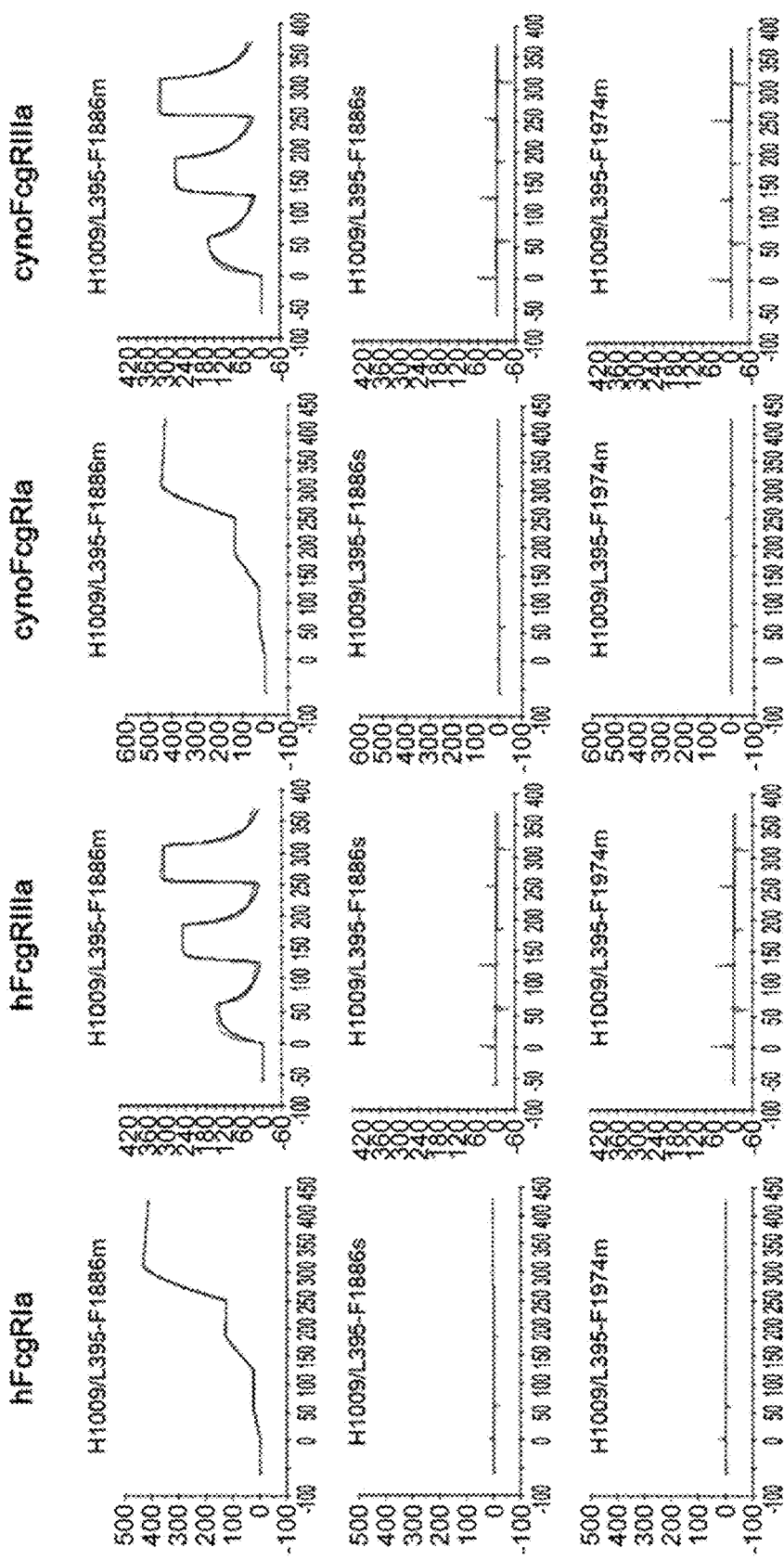

FIG. 34 shows the binding of antibodies that have the variable region of H1009/L395 and whose Fc region is a variant (F1886m, F1886s, or F1974m) to each FcγR.

Figure 35:
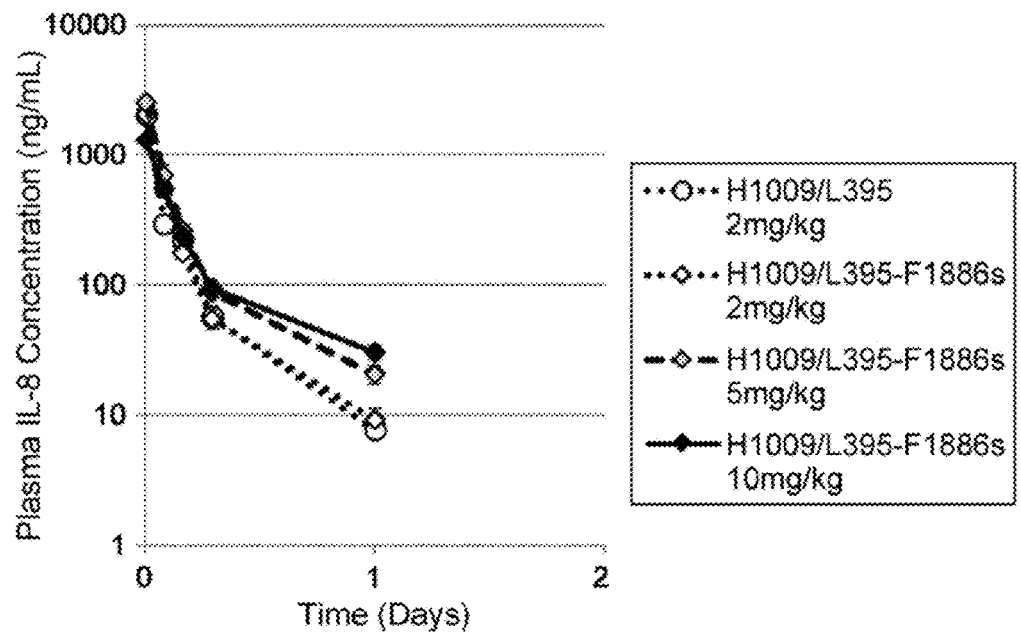

FIG. 35 shows changes of the human IL-8 concentration in mouse plasma when an anti-IL-8 antibody was administered to human FcRn transgenic mice in a mixture with human IL-8. In this case, the anti-IL-8 antibody was H1009/L395-IgG1 (2 mg/kg) which comprises the variable region of H1009/L395 and the Fc region of a native human IgG1, or H1009/L395-F1886s (2, 5 or 10 mg/kg) which comprises the variable region of H1009/L395 and the modified Fc region.

Figure 36:
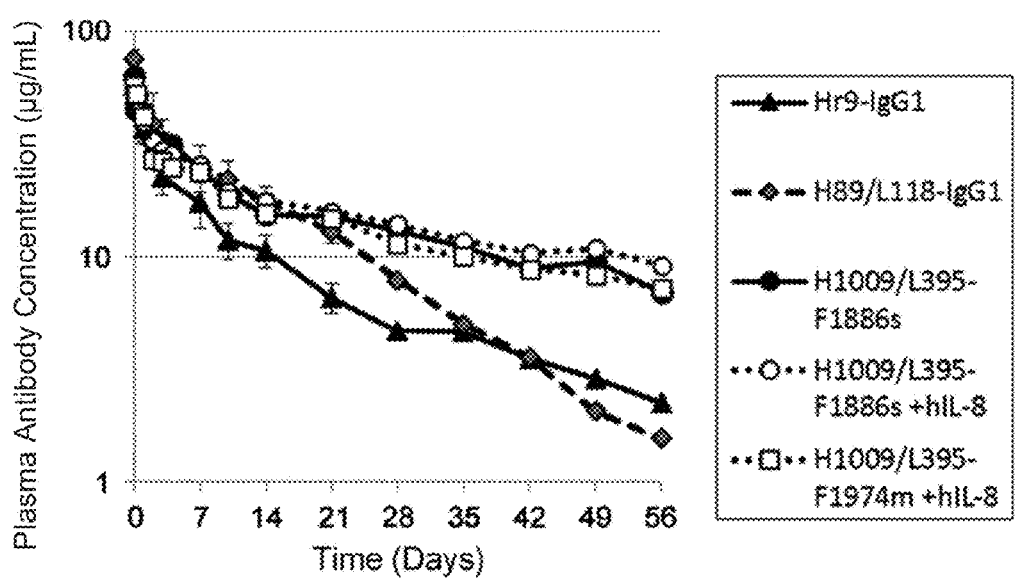

FIG. 36 shows changes in the antibody concentration in the plasma of cynomolgus when administered with Hr9-IgG1 or H89/L118-IgG1, both of which comprise the Fc region of a native human IgG1, or H1009/L395-F1886s or H1009/L395-F1974m, both of which comprise a modified Fc region.

Figure 37:
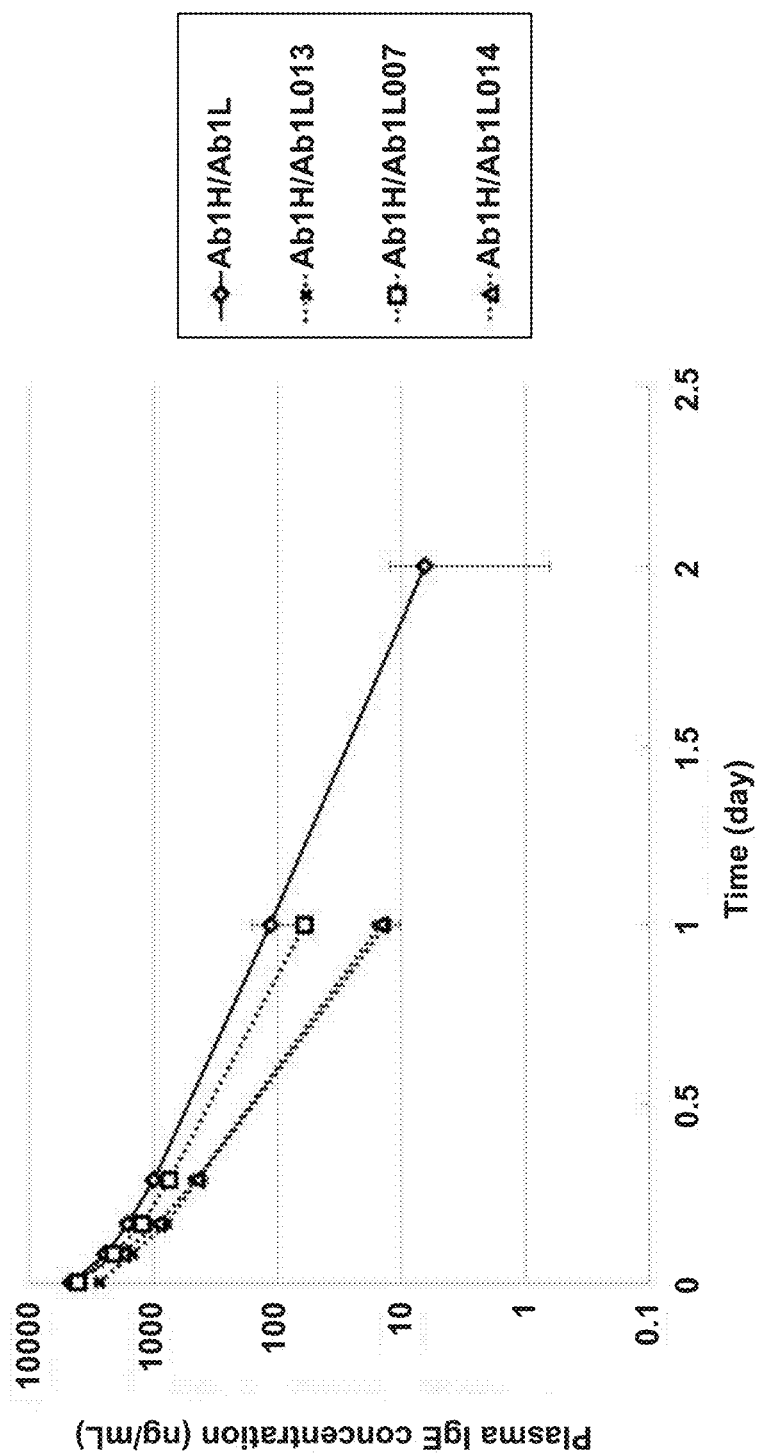
Figure 38A:
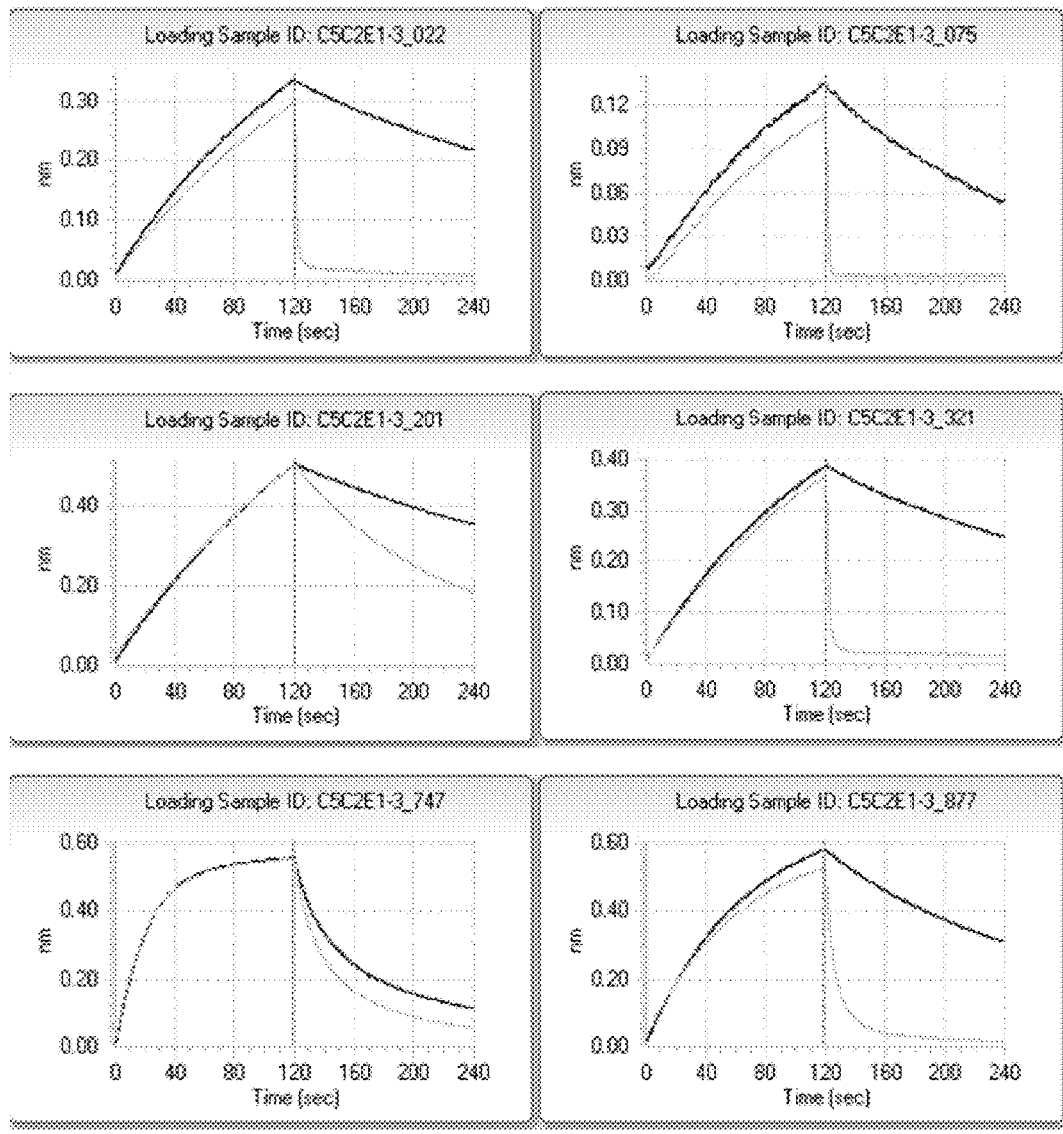
Figure 38B:
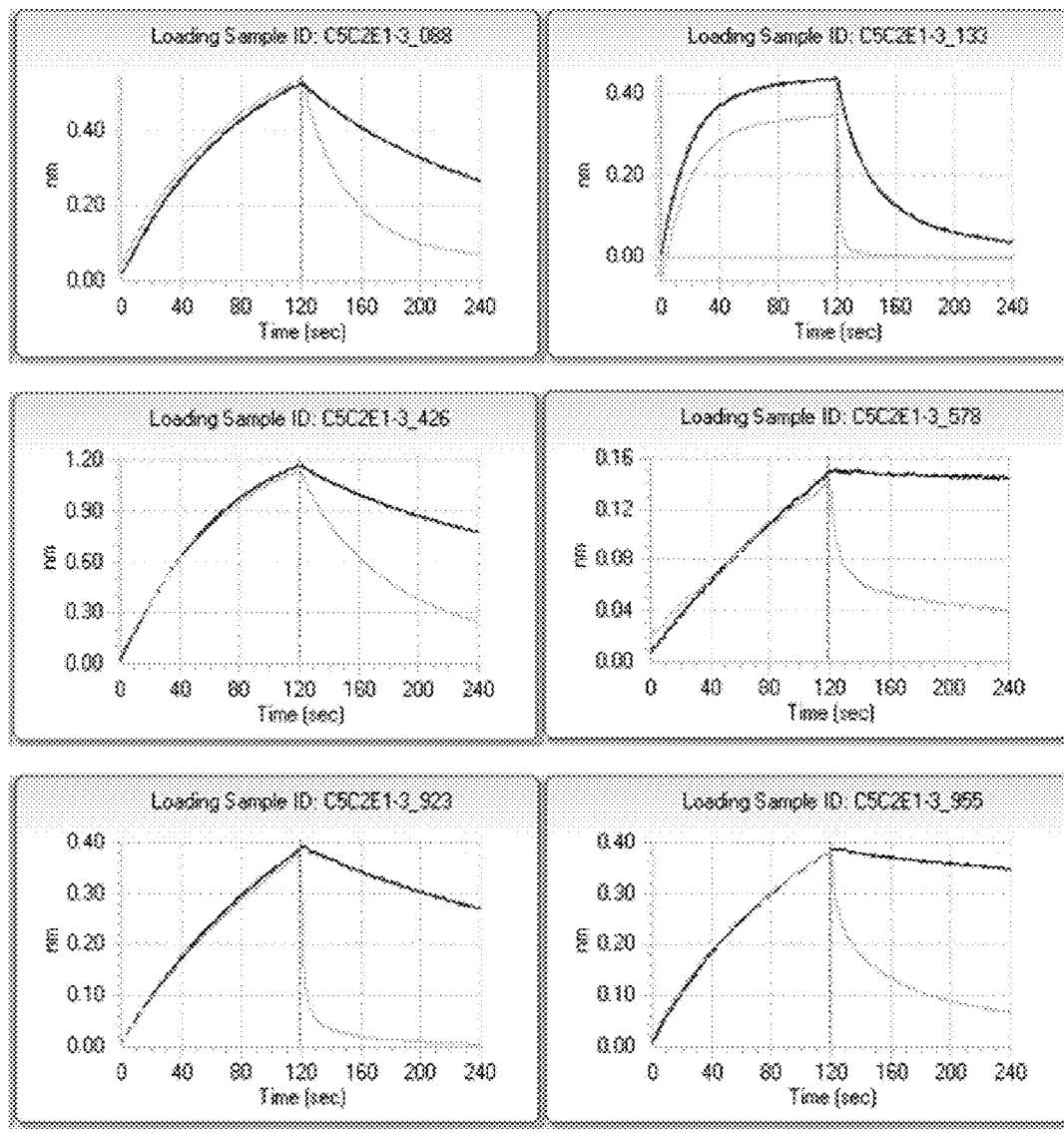
Figure 38C:
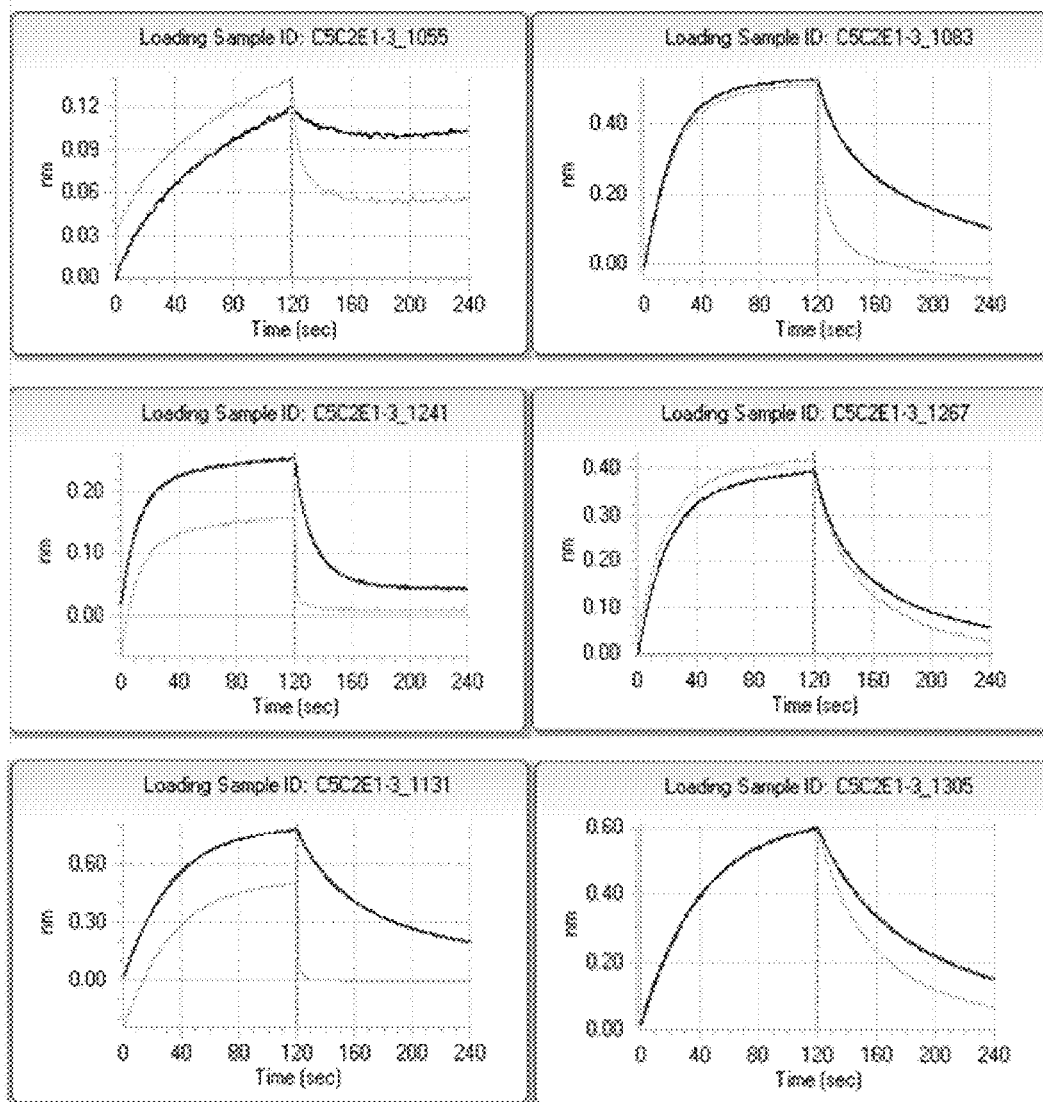
Figure 38D:
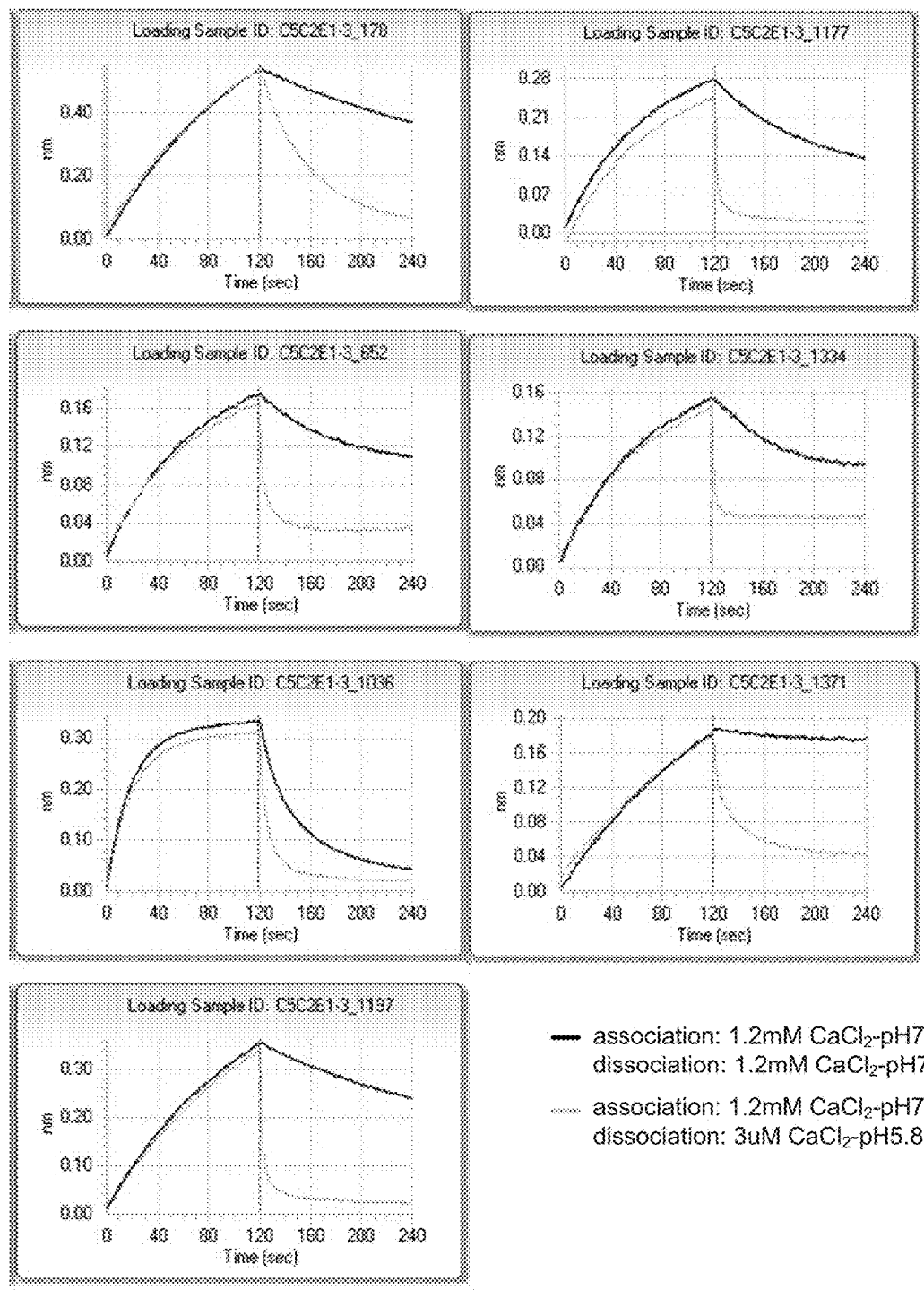

FIG. 37 shows the IgE plasma concentration time profile of some anti-IgE antibodies in C57BL6J mice in terms of the antibody variable region modification.

FIG. 38 (FIGS. 38A-38D) shows Octet sensorgrams of selected 25 [twenty five] pH-dependent and/or calcium-dependent antigen binding clones.

Figure 39:
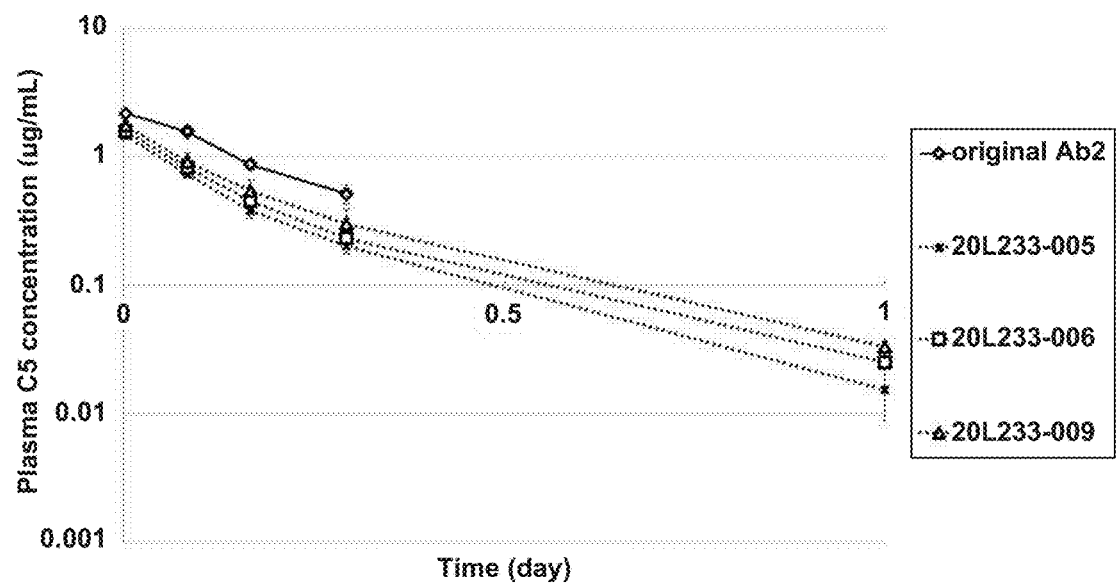

FIG. 39 shows the C5 plasma concentration time profile of some anti-C5 bispecific antibodies in C57BL6J mice in terms of the antibody variable region modification.

Figure 40:
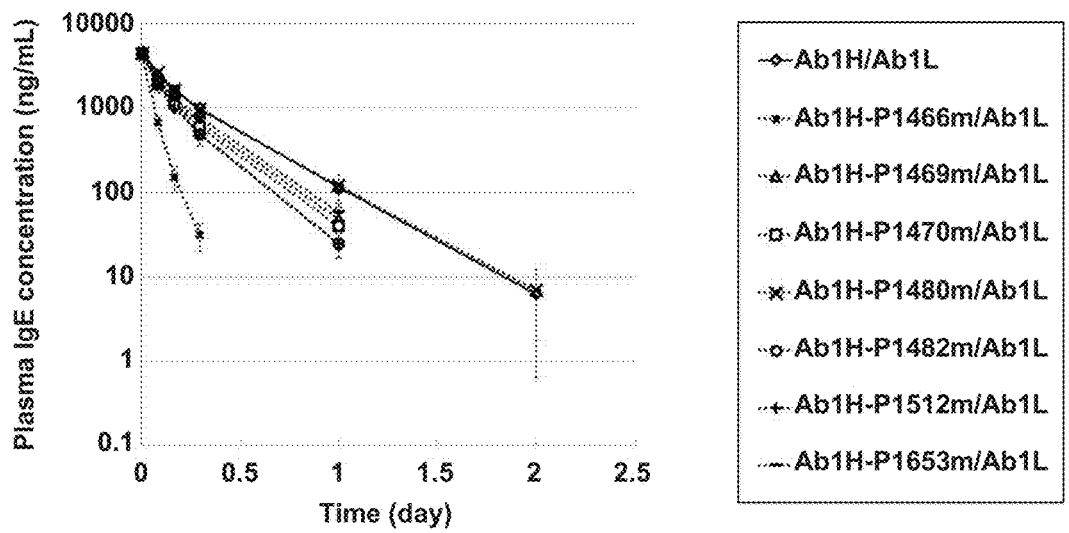

FIG. 40 shows the IgE plasma concentration time profile of some anti-IgE antibodies in C57BL6J mice in terms of the antibody constant region modification.

DETAILED DESCRIPTION

Non-limiting embodiments of Disclosure A, B or C are described hereinbelow. All embodiments described in the Examples hereinbelow are described with the intention to be rightfully understood to be also described in the section on "DETAILED DESCRIPTION", without constraints by any patent practices, ordinance, regulations, or others that may be attempted to narrowly interpret the contents described in the Examples in countries where acquisition of patent right from the present patent application is intended.
Disclosure A or Disclosure B In some embodiments, Disclosure A relates to antibodies comprising an antigen-binding domain whose antigen-binding activity changes according to ion concentration conditions, in which the isoelectric point (pI) is increased by modification of at least one amino acid residue that may be exposed on the antibody surface (herein, also referred to as "ion concentration-dependent antibodies with increased pI" within the scope of Disclosure A; and the antigen-binding domains of the antibodies are also referred to as "ion concentration-dependent antigen-binding domains with increased pI"). The invention is partly based on the surprising discovery of the inventors that antigen elimination from plasma can be facilitated with an ion concentration-dependent antibody whose isoelectric point (pI) has been increased by the modification of at least one amino acid residue that can be exposed on the antibody surface (for example, when the antibody is administered in vivo); and that binding of an antibody to the extracellular matrix can be increased with an ion concentration-dependent antibody with increased (elevated) pI. The invention is also partly based on the surprising discovery of the inventors that this beneficial effect is brought about by combining two entirely different concepts of: an ion concentration-dependent antigen-binding domain or ion concentration-dependent antibody; and an antibody whose pI is increased by modification of at least one amino acid residue that can be exposed on the surface (herein, also referred to as an "antibody with increased pI" within the scope of Disclosure A; and an antibody whose pI is decreased (reduced) by modification of at least one amino acid residue that can be exposed on the surface is referred to as an "antibody with decreased pI" within the scope of Disclosure A). The invention is thus categorized as a type of pioneer invention which can lead to remarkable technological innovation in the field (e.g., medical field) to which Disclosure A belongs.

As a matter of course, for example, an antibody comprising an antigen-binding domain and whose pI is increased by modification of at least one amino acid residue that can be exposed on the antibody surface, which has been further modified so that the antigen-binding activity of the antigen-binding domain changes according to ion concentration conditions, are also included within the scope of Disclosure A described herein (herein, such antibody is also referred to as an "ion concentration-dependent antibody with increased pI" within the scope of the Disclosure A).

As a matter of course, for example, an antibody containing an ion concentration-dependent antigen-binding domain in which at least one amino acid residue that can be exposed on the antibody surface has a charge different from that of the at least one amino acid residue at the corresponding position(s) in an antibody before modification (native antibody (for example, native Ig antibody, preferably native IgG antibody), or reference or parent antibody (e.g., antibody before modification, or antibody prior to or during library construction, or the like)), and whose net antibody pI is increased is also included in Disclosure A described herein (such antibody is also referred to as an "ion concentration-dependent antibody with increased pI" within the scope of Disclosure A described herein).

As a matter of course, for example, an antibody containing an ion concentration-dependent antigen-binding domain, whose pI is increased by modification of at least one amino acid residue that can be exposed on the antibody surface in an antibody before the modification (native antibody (for example, native Ig antibody, preferably native IgG antibody, or reference or parent antibody (e.g., antibody before the modification, or antibody prior to or during library construction, or the like)) is also included in Disclosure A described herein (such antibody is also referred to as an "ion concentration-dependent antibody with increased pI" within the scope of Disclosure A described herein).

As a matter of course, for example, an antibody containing an ion concentration-dependent antigen-binding domain in which at least one amino acid residue that can be exposed on the antibody surface is modified for the purpose of increasing the pI of the antibody is also included in Disclosure A described herein (such antibody is also referred to as an "ion concentration-dependent antibody with increased pI" within the scope of Disclosure A described herein).

Within the scope of Disclosures A and B described herein, "amino acids" include not only natural amino acids but also unnatural amino acids. Within the scope of Disclosures A and B described herein, amino acids or amino acid residues may be represented by either one-letter (for example, A) or three-letter codes (for example, Ala), or both (for example, Ala(A)).

As used in the context of Disclosures A and B, "modification of an amino acid", "modification of an amino acid residue", or an equivalent phrase may be understood as, without being limited thereto, chemically modifying one or more (for example, 1, 2, 3, 4, 5, 6, 7, 8, 9, 10, or more than 10) specific amino acids (residues) in an antibody amino acid sequence with a molecule or adding, deleting, substituting or inserting one or more (for example, 1, 2, 3, 4, 5, 6, 7, 8, 9, 10, or more than 10) amino acids in an antibody amino acid sequence. Amino acid addition, deletion, substitution, or insertion can be carried out to a nucleic acid encoding an amino acid sequence, for example, by site-directed mutagenesis (Kunkel et al., *Proc. Natl. Acad. Sci. USA* 82:488-492 (1985)) or overlap extension PCR; via affinity maturation of antibodies, or by using chain shuffling of antibody heavy chains or light chains; or by antigen panning-based selection using phage-display libraries (Smith et al., *Methods Enzymol.* 217:228-257 (1993)); and these can be performed alone or in appropriate combinations. Such amino acid modification is carried out preferably, without limitation, by substituting one or more amino acid residue in an antibody amino acid sequence with a different amino acid (individually). Amino acid addition, deletion, substitution, or insertion, and modification of an amino acid sequence by humanization or chimerization can be carried out by methods known in the art. Alteration or modification of an amino acid (residue), such as amino acid addition, deletion, substation, or insertion, may also be performed on an antibody variable region or an antibody constant region to be used in preparing recombinant antibodies for the antibodies of Disclosure A or B.

In one embodiment within the scope of Disclosures A and B described herein, substitution of amino acids (residues) refers to substitution with different amino acids (residues), and can be designed to modify, for example, matters such as in (a) to (c): (a) the polypeptide backbone structure in a region of sheet or helical conformation; (b) charge or hydrophobicity at a target site; or (c) size of a side chain.

Amino acid residues are classified, based on properties of the side chains in the structure, for example, into the groups of: (1) hydrophobic: norleucine, Met, Ala, Val, Leu, and Ile; (2) neutral, hydrophilic: Cys, Ser, Thr, Asn, and Gln; (3) acidic: Asp and Glu; (4) basic: His, Lys, and Arg; (5) residues that affect the chain orientation: Gly and Pro; and (6) aromatic: Trp, Tyr, and Phe.

Substitution of amino acid residues within each group is referred to as conservative substitution, while substitution of amino acid residues between different groups is referred to as non-conservative substitution. Substitution of amino acid residues may be conservative substitution, non-conservative substitution, or a combination thereof. Several known appropriate methods may be used for substituting amino acids with those other than natural amino acids (Wang et al., *Annu. Rev. Biophys. Biomol. Struct.* 35:225-249 (2006); Forster et al., *Proc. Natl. Acad. Sci. USA* 100(11):6353-6357 (2003)). It is possible to use, for example, a cell-free translation system containing tRNA in which an unnatural amino acid is linked to amber suppressor tRNA complementary to UAG codon (amber codon) which is a stop codon (Clover Direct (Protein Express)).

Within the scope of Disclosures A and B described herein, it is understood that the structure of an "antigen" is not limited to a specific structure as long as the antigen includes an epitope that binds to an antibody. The antigen may be an inorganic or organic substance. Antigens may be any ligands, including various cytokines, for example, interleukins, chemokines, and cell growth factors. Alternatively, as a matter of course, for example, receptors that are present as in a soluble form or have been modified to be a soluble form in biological fluids such as plasma can also be used as antigens. Non-limiting examples of such soluble receptors include the soluble IL-6 receptor described in Müllberg et al., *J. Immunol.* 152(10):4958-4968 (1994). Furthermore, antigens may be monovalent (for example, soluble IL-6 receptor) or multivalent (for example, IgE).

In one embodiment, antigens that can be bound by an antibody of Disclosures A and B are preferably soluble antigens present in biological fluids (for example, biological fluids illustrated in WO2013/125667, preferably plasma, interstitial fluid, lymphatic fluid, ascitic fluid, or pleural fluid) of subjects (within the scope of Disclosures A and B described herein, subjects to be administered (applied) with the antibody, which can be virtually any animal, for example, a human, mouse, etc.); however, the antigens may also be membrane antigens.

Within the scope of Disclosures A and B described herein, "prolongation of the half-life in plasma" or "shortening of the half-life in plasma" of a target molecule (which may be an antigen or antibody), or an equivalent phrase thereof can also be represented more specifically using in addition to the parameter of half-life in plasma (t1/2), any other parameter such as mean retention time in plasma, clearance (CL) in plasma, and area under the concentration curve (AUC) (Pharmacokinetics: Enshuniyoru Rikai (Understanding through practice) Nanzando). These parameters can be specifically assessed, for example, by carrying out noncompartmental analysis according to the protocol appended to the in vivo kinetics analysis software WinNonlin (Pharsight). It is known to those of ordinary skill in the art that these parameters normally correlate with one another.

Within the scope of Disclosures A and B described herein, an "epitope" refers to an antigenic determinant in an antigen and means a site on an antigen at which the antigen-binding domain of an antibody binds. Thus, an epitope can be defined, for example, based on its structure. Alternatively, the epitope may be defined by the antigen-binding activity of an antibody that recognizes the epitope. When an antigen is a peptide or polypeptide, the epitope can be specified by the amino acid residues that constitute the epitope. Alternatively, when an epitope is a sugar chain, the epitope can be specified based on its specific sugar chain structure. An antigen-binding domain of Disclosures A and B may bind to a single epitope or different epitopes on an antigen.

A linear epitope may be a primary amino acid sequence. Such a linear epitope typically contains at least three and commonly at least five, for example, 8 to 10 amino acids or 6 to 20 amino acids as a unique sequence.

In a conformational epitope, typically the amino acids that constitute the epitope are not present consecutively as a primary sequence. An antibody can recognize a conformational epitope in the three-dimensional structure of a peptide or protein. Methods for determining the conformation of an epitope include, but are not limited to, X ray crystallography, two-dimensional nuclear magnetic resonance, site-specific spin labeling, and electron paramagnetic resonance (Epitope Mapping Protocols in Methods in Molecular Biology (1996), Vol. 66, Morris (ed.)).

Within the scope of Disclosures A and B described herein, an "antibody" is not particularly limited and used in the broadest sense, as long as it can bind to an antigen of target. Non-limiting examples of antibodies include widely known common antibodies (for example, native immunoglobulins (abbreviated as "Ig")), and molecules and variants derived therefrom, for example, Fab, Fab', F(ab')$_2$, diabodies, ScFv (Holliger et al., *Proc. Natl. Acad. Sci. USA* 90:6444-6448 (1993); EP404,097; WO93/11161; Peer et al., *Nature Nanotechnology* 2:751-760 (2007)), low molecular weight antibodies (minibodies) (Orita et al., *Blood* 105:562-566 (2005)), scaffold proteins, one-armed antibodies (including all embodiments of one-armed antibodies described in WO2005/063816), multispecific antibodies (for example, bispecific antibodies: antibodies with specificity to two different epitopes, including antibodies that recognize different antigens and antibodies that recognize different epitopes on a same antigen). Within the scope of Disclosures A and B described herein, "bispecific antibodies" are not limited but may be prepared, for example, as antibody molecules having the common L chain described in WO2005/035756, or by the method described in WO2008/119353 where two general types of antibodies having an IgG4-like constant regions are mixed to cause an exchange reaction between the two types of such antibodies (known as the "Fab-arm exchange" method to those of ordinary skill in the art). In an alternative embodiment, they may be antibodies having a structure where the heavy-chain variable region and the light-chain variable region are linked together as a single chain (for example, sc(Fv)$_2$). Alternatively, they may be antibody-like molecules (for example, scFv-Fc) that result from linking the Fc region (a constant region that lacks the CH1 domain) to scFv (or sc(Fv)$_2$) where the heavy-chain variable region (VH) is linked to the light-chain variable region (VL). Multispecific antibodies consisting of scFv-Fc have an (scFv)$_2$-Fc structure where the first and second polypeptides are VH1-linker-VL1-Fc and VH2-linker-VL2-Fc, respectively. Alternatively, they may be antibody-like molecules where a single-domain antibody is linked to an Fc region (Marvin et al., *Curr. Opin. Drug Discov. Devel.* 9(2):184-193 (2006)), Fc fusion proteins (for example, immunoadhesin) (US2013/0171138), functional fragments thereof, substances functionally equivalent thereto, and sugar chain-modified variants thereof. Herein, native IgG (e.g. native IgG1) refers to polypeptides that contain the same amino acid sequence as that of naturally occurring IgG (e.g. native IgG1) and belongs to the class of antibodies encoded substantially by the immunoglobulin gamma gene. Native IgG may be spontaneous mutants thereof and the like.

Typically, where an antibody has a structure that is substantially the same as or similar to that of native IgG, the Y-shaped structure of the four chains (two heavy chain polypeptides and two light chain polypeptides) can be the basic structure. Typically, the heavy chain and the light chain can be linked together via a disulfide bond (SS bond) and form a heterodimer. Such heterodimers may be linked together via a disulfide bond and form a Y-shaped heterotetramer. The two heavy chains or light chains may be identical or different from each other.

For example, an IgG antibody may be cleaved into two units of Fab (region) and a single unit of Fc (region) by papain digestion, which cleaves the hinge region (also referred to as the "hinge" within the scope of Disclosures A and B described herein) where the heavy-chain Fab region is linked to the Fc region. Typically, the Fab region contains an antigen-binding domain. Since phagocytic cells such as leukocytes and macrophages have receptors that are capable of binding to the Fc region (Fc receptors), and can recognize via the Fc receptors antibodies that are bound to an antigen and phagocytize the antigen (opsonization). Meanwhile, the Fc region is involved in the mediation of immune reactions such as ADCC or CDC, and has an effector function of inducing a reaction upon an antibody binding to antigens. The antibody effector function is known to vary according to the type of immunoglobulin (isotype). The Fc region of the IgG class would indicate a region that spans, for example, from cysteine of position 226 or from proline of position 230 (EU numbering) to the C terminus; however, the Fc region is not limited thereto. The Fc region can be appropriately obtained by partial digestion of a monoclonal IgG1, IgG2, IgG3, or IgG4 antibody, or others, with a protease such as pepsin, followed by elution of adsorbed fractions from a protein A or protein G column.

Within the scope of Disclosures A and B described herein, the positions of amino acid residues in the variable region (CDR(s) and/or FR(s)) of an antibody are shown according to Kabat, whereas the positions of amino acid residues in the constant region or Fc region are shown according to EU numbering based on Kabat's amino acid positions (Sequences of Proteins of Immunological Interest (National Institute of Health, Bethesda, Md., 1987 and 1991).

Within the scope of Disclosures A and B described herein, "library" may refer to molecules (populations) such as multiple antibodies that have sequence variability, in which their respective sequences may be the same or different from one another; multiple fusion polypeptides containing the antibodies; or nucleic acids or polynucleotides encoding these amino acid sequences, as described in detail in WO2013/125667 (for example, paragraphs 0121-0125). The library may, for example, contain at least $10^4$ antibody molecules, more preferably, at least $10^5$ antibody molecules, even more preferably, at least $10^6$ antibody molecules, particularly preferably, at least $10^7$ antibody molecules or more. The library may be phage libraries. The phrase "primarily consist of" means that antibodies which may have different antigen-binding activities account for a certain portion among the numerous independent clones with different sequences in the library. In one embodiment, immune libraries that are constructed based on antibody genes derived from lymphocytes of animals immunized with a specific antigen, patients with infection, humans with elevated antibody titer in blood due to vaccination, or patients with cancer or autoimmune disease can be appropriately used as randomized variable region libraries. In an alternative embodiment, naive libraries containing naive sequences (antibody sequences without bias in the repertoire), which are constructed from antibody genes derived from lymphocytes of healthy persons, can also be appropriately used as randomized variable region libraries (Gejima et al., *Human Antibodies* 11:121-129 (2002)); Cardoso et al., *Scand. J. Immunol.* 51:337-344 (2000)). Amino acid sequences containing naive sequences can refer to those obtained from such naive libraries. In an alternative embodiment, synthetic libraries in which the CDR sequence from a V gene of genomic DNA or a reconstructed functional V gene is substituted with a set of synthetic oligonucleotides containing a sequence encoding a codon set of appropriate length can also be appropriately used as randomized variable region libraries. In this case, it is also possible to substitute only the heavy chain CDR3 sequence, since sequence variations are observed in the CDR3 gene. A standard way to produce amino acid diversity in the antibody variable region may be to increase variations of amino acid residues at positions that can be exposed on the antibody surface.

In one embodiment, where antibodies of Disclosure A or B, for example, have a structure that is substantially the same as or similar to the structure of native Ig antibodies, they typically have variable regions ("V regions") [heavy chain variable region ("VH region") and light chain variable region ("VL region")] and constant regions ("C regions") ["heavy chain constant region ("CH region") and light chain constant region ("CL region")]. The CH region is further divided into three: CH1 to CH3. Typically, the Fab region of the heavy chain contains VH region and CH1, and typically the Fc region of the heavy chain contains CH2 and CH3. Typically, the hinge region is located between CH1 and CH2. Furthermore, the variable region typically has complementarity determining regions ("CDRs") and framework regions ("FRs"). Typically, the VH region and VL region each have three CDRs (CDR1, CDR2, and CDR3) and four FRs (FR1, FR2, FR3, and FR4). Typically, the six CDRs in the variable regions of the heavy chain and light chain interact and form the antigen-binding domain of the antibody. On the other hand, where there is only one single CDR, while the antigen-binding affinity is known to be lower as compared to where six CDRs are present, it has still the ability to recognize and bind to the antigen.

Ig antibodies are classified into several classes (isotypes) based on structural differences in their constant regions. In many mammals, they are categorized into five immunoglobulin classes based on structural differences in the constant region: IgG, IgA, IgM, IgD, and IgE. Furthermore, in the case of human, IgG has four subclasses: IgG1, IgG2, IgG3, and IgG4; and IgA has two subclasses: IgA1 and IgA2. The heavy chain is classified into γ chain, μ chain, α chain, δ chain, and ε chain according to differences in the constant region, and based on these differences, there are five immunoglobulin classes (isotypes): IgG, IgM, IgA, IgD, and IgE. On the other hand, there are two types of light chains: λ chain and κ chain, and all immunoglobulins have either of these two.

In one embodiment, where an antibody of Disclosure A or B has a heavy chain, for example, the heavy chain may be any one of γ chain, μ chain, α chain, δ chain, and ε chain, or may be derived from any one of them, and where an antibody of Disclosure A or B has a light chain, for example, the light chain may be either κ chain or λ chain, or may be derived from either. Furthermore, within the scope of Disclosures A and B described herein, the antibody may be of any isotype (for example, IgG, IgM, IgA, IgD, or IgE) and of any subclass (for example, human IgG1, IgG2, IgG3, IgG4, IgA1, and IgA2; mouse IgG1, IgG2a, IgG2b, and IgG3), or may be derived from any one of them, but is not limited thereto.

Within the scope of Disclosures A and B described herein, an "antigen-binding domain" may have any structure as long as it binds to an antigen of interest. Such domains may include, for example, the variable regions of antibody heavy chains and light chains (for example, 1 to 6 CDRs); a module of about 35 amino acids referred to as A domain, which is contained in Avimer, a cell membrane protein present in the body (WO2004/044011 and WO2005/040229); Adnectin containing the 10Fn3 domain which binds to the protein in the glycoprotein fibronectin expressed on cell membrane (WO2002/032925); Affibody, having as scaffold the IgG-binding domain constituting a three-helix bundle of 58 amino acids of Protein A (WO1995/001937); Designed Ankyrin Repeat Proteins (DARPins) which are a region exposed on the molecular surface of an Ankyrin repeat (AR) having a structure in which a subunit with a turn containing 33 amino acid residues, two antiparallel helices, and a loop is repeatedly stacked (WO2002/020565); Anticalins and others, which are a four loop region supporting one side of a centrally-twisted barrel structure of eight antiparallel strands that are highly conserved among lipocalin molecules such as neutrophil gelatinase-associated lipocalin (NGAL) (WO2003/029462); and the concave region formed by the parallel-sheet structure inside the horseshoe-shaped structure formed by stacked repeats of the leucine-rich-repeat (LRR) module of the variable lymphocyte receptor (VLR) which does not have a immunoglobulin structure and is used in the system of acquired immunity in jawless vertebrates such as lamprey and hagfish (WO2008/016854). Preferred antigen-binding domains of Disclosure A or B may include those having IgG antibody heavy-chain and light-chain variable regions, and more specifically, ScFv, single chain antibodies, Fv, scFv$_2$ (single chain Fv$_2$), Fab, and F(ab')$_2$.

In one embodiment of Disclosure A, "ion concentration" is not particularly limited and refers to hydrogen ion concentration (pH) or metal ion concentration. Herein, "metal ions" can be any one of ions of group I elements except hydrogen, such as alkaline metals and copper group elements, group II elements such as alkaline earth metals and zinc group elements, group III elements except boron, group IV elements except carbon and silicon, group VIII elements such as iron group and platinum group elements, elements belonging to subgroup A of groups V, VI, and VII, and metal elements such as antimony, bismuth, and polonium. Metal atoms have the property of releasing valence electrons to become cations. This is referred to as ionization tendency. Metals with strong ionization tendency are assumed to be chemically active.

In one embodiment of Disclosure A, preferred metal ions may be calcium ion, as described in detail in WO2012/073992 and WO2013/125667.

In one embodiment of Disclosure A, "ion concentration condition(s)" may be a condition that focuses on differences in the biological behavior of an ion concentration-dependent antibody between a low ion concentration and a high ion concentration. Furthermore, "the antigen-binding activity changes according to the ion concentration condition" can mean that the antigen-binding activity of an ion concentration-dependent antigen-binding domain or an ion concentration-dependent antibody of Disclosure A or B changes between a low ion concentration and a high ion concentration. Such cases include, for example, those with higher (stronger) or lower (weaker) antigen-binding activity at a high ion concentration than at a low ion concentration, without being limited thereto.

In one embodiment of Disclosure A, the ion concentration can be hydrogen ion concentration (pH) or calcium ion concentration. Where the ion concentration is hydrogen ion concentration (pH), the ion concentration-dependent antigen-binding domain may also be referred to as a "pH-dependent antigen-binding domain"; and where the ion concentration is calcium ion concentration, it may also be referred to as a "calcium ion concentration-dependent antigen-binding domain".

In one embodiment in the context of Disclosure A, the ion concentration-dependent antigen-binding domains, ion concentration-dependent antibodies, ion concentration-dependent antigen-binding domains with increased pI, and ion concentration-dependent antibodies with increased pI can be obtained from libraries primarily consisting of antibodies that differ in sequence (have variability) and whose antigen-binding domains contain at least one amino acid residue that causes a change in the antigen-binding activity of the antigen-binding domain or antibody according to the ion concentration condition. The antigen-binding domains may be preferably located within the light chain variable region (which may be modified) and/or the heavy chain variable region (which may be modified). Furthermore, to construct a library, such light-chain or heavy-chain variable regions may be combined with heavy-chain or light-chain variable regions constructed as a randomized variable region sequence library. Where the ion concentration is hydrogen or calcium ion concentration, non-limiting examples of the library include, for example, libraries in which heavy chain variable regions constructed as a randomized variable region sequence library are combined with light chain variable region sequences in which amino acid residue(s) in a germ line sequence such as SEQ ID NO:1 (Vk1), SEQ ID NO:2 (Vk2), SEQ ID NO:3 (Vk3), or SEQ ID NO:4 (Vk4) has been substituted with at least one amino acid residue that can alter the antigen-binding activity depending on ion concentrations. Furthermore, where the ion concentration is calcium ion concentration, the library includes, for example, those in which the heavy chain variable region sequence of SEQ ID NO:5 (6RL#9-IgG1) or SEQ ID NO:6 (6KC4-1#85-IgG1) is combined with light chain variable regions constructed as a randomized variable region sequence library or light chain variable regions having a germ line sequence.

In one embodiment, where the ion concentration is calcium ion concentration, the high calcium ion concentration is not particularly limited to a specific value; however, the concentration may be selected between 100 μM and 10 mM, between 200 μM and 5 mM, between 400 μM and 3 mM, between 200 μM and 2 mM, or between 400 μM and 1 mM. A concentration selected between 500 μM and 2.5 mM, which is close to the plasma (blood) concentration of calcium ion in vivo, may be also preferred. The low calcium ion concentration is not particularly limited to a specific value; however, the concentration may be selected between 0.1 μM and 30 between 0.2 μM and 20 between 0.5 and 10 or between 1 μM and 5 or between 2 μM and 4 μM. A concentration selected between 1 μM and 5 which is close to the concentration of calcium ion in early endosomes in vivo, may be also preferred.

Whether the antigen-binding activity of an antigen-binding domain or antibody containing the domain changes according to the metal ion concentration (for example, calcium ion concentration) condition can be readily determined by known methods, for example, by the methods described herein in the context of Disclosure A, or described in WO2012/073992. For example, the antigen-binding activity of an antigen-binding domain or antibody containing the domain can be measured at low and high calcium ion concentrations and compared. In this case, conditions other than the calcium ion concentration may be preferably the same. Furthermore, conditions other than the calcium ion concentration in determining the antigen-binding activity can be appropriately selected by those of ordinary skill in the art. The antigen-binding activity can be determined, for example, under the conditions of HEPES buffer at 37° C., or using the BIACORE (GE Healthcare) or others.

In one embodiment in the context of Disclosure A, it is preferable that the antigen-binding activity of the ion concentration-dependent antigen-binding domain, ion concentration-dependent antibody, ion concentration-dependent antigen-binding domain with increased pI, or ion concentration-dependent antibody with increased pI is higher under a high calcium ion concentration condition than under a low calcium ion concentration condition. In this case, the ratio between the antigen-binding activity under a low calcium ion concentration condition and the antigen-binding activity under a high calcium ion concentration condition is not limited; however, the value of the ratio of the KD (dissociation constant) for an antigen under a low calcium ion concentration condition to the KD under a high calcium ion concentration condition, i.e., KD (3 Ca)/KD (2 mM Ca), may be preferably 2 or more, more preferably 10 or more, and still more preferably 40 or more. The upper limit of the KD (3 μM Ca)/KD (2 mM Ca) value is not limited, and may be any value such as 400, 1000, or 10000.

Where the antigen is a soluble antigen, the dissociation constant (KD) can be used as the value for antigen-binding activity. Meanwhile, where the antigen is a membrane antigen, the apparent dissociation constant (KD) can be used. The dissociation constant (KD) and apparent dissociation constant (KD) can be determined by known methods, for example, by BIACORE (GE healthcare), Scatchard plot, or flow cytometer.

Alternatively, for example, the dissociation rate constant (kd) can also be used as another indicator to represent the binding activity ratio. Where the dissociation rate constant (kd) is used instead of the dissociation constant (KD) as an indicator to represent the antigen binding activity ratio, the value of the ratio of the low-calcium-ion-concentration-condition dissociation rate constant (kd) to the high-calcium-ion-concentration-condition dissociation rate constant (kd), i.e., kd (low calcium ion concentration condition)/kd (high calcium ion concentration condition), may be preferably 2 or more, more preferably 5 or more, still more preferably 10 or more, and yet more preferably 30 or more. The upper limit of the kd (low calcium ion concentration condition)/kd (high calcium ion concentration condition) value is not limited, and may be any value such as 50, 100, or 200.

Where the antigen is a soluble antigen, the dissociation rate constant (kd) can be used as the value for antigen-binding activity. Meanwhile, where the antigen is a membrane antigen, the apparent dissociation rate constant (kd) can be used. The dissociation rate constant (kd) and the apparent dissociation rate constant (kd) can be determined by known methods, for example, by BIACORE (GE healthcare) or flow cytometer.

In one embodiment, methods for producing or screening for calcium ion concentration-dependent antigen-binding domains or calcium ion concentration-dependent antibodies whose antigen-binding activity is higher at a high calcium ion concentration condition than at a low calcium ion concentration condition, or libraries thereof, are not limited. The methods include, for example, those described in WO2012/073992 (for example, paragraphs 0200-0213).

Such a method may comprise, for example:
(a) determining the antigen-binding activity of an antigen-binding domain or antibody at a low calcium ion concentration condition;

(b) determining the antigen-binding activity of an antigen-binding domain or antibody at a high calcium ion concentration condition; and
(c) selecting an antigen-binding domain or antibody whose antigen-binding activity at a low calcium ion concentration condition is lower than the antigen-binding activity at a high calcium ion concentration condition.

Alternatively, the method may comprise, for example:
(a) contacting an antigen with an antigen-binding domain or antibody, or a library thereof, at a high calcium ion concentration condition;
(b) incubating an antigen-binding domain or antibody that bound to the antigen in step (a) at a low calcium ion concentration condition; and
(c) isolating an antigen-binding domain or antibody that dissociated in step (b).

Alternatively, the method may comprise, for example:
(a) contacting an antigen with an antigen-binding domain or antibody, or a library thereof at a low calcium ion concentration condition;
(b) selecting an antigen-binding domain or antibody that does not bind to the antigen or has a low antigen-binding ability in step (a);
(c) allowing the antigen-binding domain or antibody selected in step (b) to bind to the antigen at a high calcium ion concentration condition; and
(d) isolating the antigen-binding domain or antibody that bound to the antigen in step (c).

Alternatively, the method may comprise, for example:
(a) contacting an antigen-binding domain or antibody, or a library thereof with an antigen-immobilized column at a high calcium ion concentration condition;
(b) eluting an antigen-binding domain or antibody bound to the column in step (a) from the column at a low calcium ion concentration condition; and
(c) isolating an antigen-binding domain or antibody eluted in step (b).

Alternatively, the method may comprise, for example:
(a) allowing an antigen-binding domain or antibody, or a library thereof to pass through an antigen-immobilized column at a low calcium ion concentration condition to collect an antigen-binding domain or antibody eluted without binding to the column;
(b) allowing an antigen-binding domain or antibody collected in step (a) to bind to the antigen at a high calcium ion concentration condition; and
(c) isolating an antigen-binding domain or antibody bound to the antigen in step (b).

Alternatively, the method may comprise, for example:
(a) contacting an antigen with an antigen-binding domain or antibody, or a library thereof at a high calcium ion concentration condition;
(b) obtaining an antigen-binding domain or antibody bound to the antigen in step (a);
(c) incubating an antigen-binding domain or antibody obtained in step (b) at a low calcium ion concentration; and
(d) isolating an antigen-binding domain or antibody whose antigen-binding activity in step (c) is weaker than the criterion selected in step (b).

Each step of these various screening methods may be repeated several times, or the steps may be combined appropriately to obtain the most suitable molecules. The aforementioned conditions may be suitably selected for the low and high calcium ion concentration conditions. Desired calcium ion concentration-dependent antigen-binding domains or calcium ion concentration-dependent antibodies can be obtained thereby.

In the context of Disclosure A, in one embodiment, the antigen-binding domains or antibodies as a starting material may be, for example, modified antigen-binding domains or antibodies that have an increased pI as a result of modifying the charge of at least one amino acid residue that can be exposed on their surface. In an alternative embodiment, where amino acids that change the binding activity of an ion concentration-dependent antigen-binding domain are introduced into the sequence, they may be introduced in conjunction with a charge modification of at least one amino acid residue that can be exposed on the surface of the antigen-binding domain or antibody so as to increase the pI.

Alternatively, in the context of present invention A, for example, it is possible to use pre-existing antigen-binding domains or antibodies, preexisting libraries (phage library, etc.); antibodies prepared from hybridomas obtained by immunizing animals or from B cells of immunized animals, or libraries thereof; or antigen-binding domains, antibodies, or libraries obtained by introducing natural or unnatural amino acid mutations capable of chelating calcium (described below) thereinto (for example, libraries with an increased content of calcium-chelatable amino acids, or libraries introduced with calcium-chelatable amino acids at specific sites).

In one embodiment in the context of Disclosure A, where the ion concentration is calcium ion concentration, there is no limitation as to the type of amino acids that change the binding activity of ion concentration-dependent antigen-binding domains or ion concentration-dependent antigen-binding domains with increased pI, as long as they can form a calcium-binding motif. For example, calcium-binding motifs are known to those of ordinary skill in the art (for example, Springer et al. (*Cell* 102:275-277 (2000)); Kawasaki et al. (*Protein Prof* 2:305-490 (1995)); Moncrief et al. (*J. Mol. Evol.* 30:522-562 (1990)); Chauvaux et al. (*Biochem. J.* 265:261-265 (1990)); Bairoch et al. (*FEBS Lett.* 269:454-456 (1990)); Davis (*New Biol.* 2:410-419 (1990)); Schaefer et al. (*Genomics* 25:638-643 (1995)); Economou et al. (*EMBO J.* 9:349-354 (1990)); Wurzburg et al. (*Structure.* 14(6):1049-1058 (2006)). Thus, where an antigen-binding domain has an arbitrary calcium-binding motif such as of a C-type lectin, for example, ASGPR, CD23, MBR, or DC-SIGN, the antigen-binding activity of the domain can be changed according to the calcium ion concentration condition. Such calcium-binding motifs may include, for example, in addition to those described above, the calcium-binding motif included in the antigen-binding domain shown in SEQ ID NO:7 (which corresponds to "Vk5-2").

In one embodiment in the context of Disclosure A, where the ion concentration is calcium ion concentration, amino acids having a metal-chelating activity may be used as amino acids that change the binding activity of ion concentration-dependent antigen-binding domains or ion concentration-dependent antigen-binding domains of with increased pI. For example, any amino acids can be appropriately used as amino acids having a metal-chelating activity, as long as they can form a calcium-binding motif. Specifically, such amino acids include those having an electron-donating property. The amino acids preferably include, but are not limited to, Ser (S), Thr (T), Asn (N), Gln (Q), Asp (D), and Glu (E).

The location of such amino acids having a metal-chelating activity in an antigen-binding domain is not limited to specific positions. In one embodiment, the amino acids may be located at any positions in the heavy chain variable region and/or light chain variable region that may form an antigen-binding domain. At least one amino acid residue that causes calcium ion concentration-dependent changes in the antigen-binding activity of an antibody may be contained, for example, in CDR (one or more of CDR1, CDR2, and CDR3) and/or FR (one or more of FR1, FR2, FR3, and FR4) of the heavy chain and/or light chain. The amino acid residue(s) may be placed, for example, at one or more of positions 95, 96, 100a, and 101 according to Kabat numbering in heavy-chain CDR3; at one or more of positions 30, 31, and 32 according to Kabat numbering in light-chain CDR1; at position 50 according to Kabat numbering in light-chain CDR2; and/or at position 92 according to Kabat numbering in light-chain CDR3. Those amino acid residues may be placed alone or in combination.

Troponin C, calmodulin, parvalbumin, myosin light chain, and others are known to have multiple calcium-binding sites and assumed to be derived from a common origin in molecular evolution, and in one embodiment, one or more of light chain CDR1, CDR2, and CDR3 can be designed to contain binding motifs thereof. For the purpose described above, for example, the cadherin domain; the EF hand contained in calmodulin; the C2 domain contained in Protein kinase C; the Gla domain contained in blood-clotting protein Factor IX; C-type lectin of the asialoglycoprotein receptor or mannose-binding receptor; the A domain contained in the LDL receptor; Annexin; thrombospondin type-3 domain; and EGF-like domain may be suitably used.

In one embodiment, where the ion concentration is hydrogen ion concentration (pH), the concentration condition of proton, i.e., nucleus of a hydrogen atom, is used synonymously with the condition of hydrogen index (pH). Where the amount of activity of hydrogen ion in an aqueous solution is represented by $aH^+$, pH is defined as $-\log 10aH^+$. Where the ionic strength of the aqueous solution is low (for example, less than $10^{-3}$), $aH^+$ is nearly equal to the hydrogen ion strength. For example, the ionic product for water at 25° C. and 1 atmosphere is $Kw=aH^+*aOH=10^{-14}$; thus, for pure water, $aH^+=aOH=10^{-7}$. In this case, pH=7 is neutral, and an aqueous solution with a pH of less than 7 is acidic, and an aqueous solution with a pH of greater than 7 is alkaline. Thus, the hydrogen ion concentration condition may be conditions that focus on differences in the biological behavior of a pH-dependent antibody at a high hydrogen ion concentration (acidic pH range) and at a low hydrogen ion concentration (neutral pH range) for the hydrogen ion concentration condition or pH condition. For example, in the context of Disclosure A, "the antigen-binding activity at a high hydrogen ion concentration (acidic pH range) condition is lower than the antigen-binding activity at a low hydrogen ion concentration (neutral pH range) condition" can mean that the antigen-binding activity of an ion concentration-dependent antigen-binding domain, an ion concentration-dependent antibody, an ion concentration-dependent antigen-binding domain with increased pI, or an ion concentration-dependent antibody with increased pI is weaker at a pH selected from pH 4.0 to pH 6.5, preferably from pH 4.5 to pH 6.5, more preferably from pH 5.0 to pH 6.5, and still more preferably from pH 5.5 to pH 6.5, than at a pH selected from pH 6.7 to pH 10.0, preferably from pH 6.7 to pH 9.5, more preferably from pH 7.0 to pH 9.0, and still more preferably from pH 7.0 to pH 8.0. Preferably, the above expression can mean that the antigen-binding activity at the pH within early endosomes in vivo is weaker than that at the plasma pH in vivo; and specifically can mean that the antigen-binding activity of an antibody, for example, at pH 5.8 is weaker than that, for example, at pH 7.4.

Whether the antigen-binding activity of an antigen-binding domain or an antibody containing the domain changes according to the hydrogen ion concentration condition can be readily assessed by known methods, for example, by the assay methods described herein in the context of Disclosure A, or described in WO2009/125825. For example, the antigen-binding activity of an antigen-binding domain or an antibody containing the domain toward an antigen of interest may be measured at low and high hydrogen ion concentrations and compared. In this case, it is preferable that conditions other than the hydrogen ion concentration are the same. Where determining the antigen-binding activity, those of ordinary skill in the art can suitably select conditions other than the hydrogen ion concentration, and for example, measurements can be carried out under the condition of HEPES buffer at 37° C., or using the BIACORE (GE Healthcare), or the like.

Within the scope of Disclosure A described herein, unless particularly specified otherwise in the context, "neutral pH range" (also referred to as "low hydrogen ion concentration", "high pH", "neutral pH condition", or "neutral pH") is not particularly limited to a specific value; however, it may be preferably selected from pH 6.7 to pH 10.0, from pH 6.7 to pH 9.5, from pH 7.0 to pH 9.0, or from pH 7.0 to pH 8.0. The neutral pH range may be preferably pH 7.4 which is close to the in vivo pH in plasma (blood), but for the convenience of measurement, for example, pH 7.0 may be used.

Within the scope of Disclosure A described herein, unless particularly specified otherwise in the context, "acidic pH range" (also referred to as "high hydrogen ion concentration", "low pH", "acidic pH condition", or "acidic pH") is not particularly limited to a specific value; however, it may be preferably selected from pH 4.0 to pH 6.5, from pH 4.5 to pH 6.5, pH 5.0 to pH 6.5, or pH 5.5 to pH 6.5. The acidic pH range may be preferably pH 5.8 which is close to the in vivo hydrogen ion concentration in the early endosome, but for the convenience of measurement, for example, pH 6.0 may be used.

In one embodiment in the context of Disclosure A, where the ion concentration is hydrogen ion concentration, it is preferable that the antigen-binding activity of the ion concentration-dependent antigen-binding domain, ion concentration-dependent antibody, ion concentration-dependent antigen-binding domain with increased pI, or ion concentration-dependent antibody with increased pI is higher under a neutral pH condition than under an acidic pH condition. In this case, the ratio of the antigen-binding activity under a neutral pH condition to the antigen-binding activity under an acidic pH condition is not limited; however, the value of the ratio of the dissociation constant (KD) for an antigen at an acidic pH condition to the KD at a neutral pH condition, i.e., KD (acidic pH range)/KD (neutral pH range), (for example, KD (pH 5.8)/KD (pH 7.4)) may be 2 or more; 10 or more; or 40 or more. The upper limit of KD (acidic pH range)/KD (neutral pH range) value is not limited, and may be any value such as 400, 1000, or 10000.

In an alternative embodiment, it is also possible to use, for example, the dissociation rate constant (kd) as an indicator to represent the above binding activity ratio. Where the dissociation rate constant (kd) is used instead of the dissociation constant (KD) as an indicator to represent the binding activity ratio, the value of the ratio of the dissociation rate constant (kd) for an antigen at a high hydrogen ion concentration condition to that at a low hydrogen ion concentration condition, i.e., kd (acidic pH range)/kd (neutral pH range) may be 2 or more, 5 or more, 10 or more, or 30 or more. The upper limit of the kd (acidic pH range)/kd (neutral pH range) value is not limited, and may be any value such as 50, 100, or 200.

Where the antigen is a soluble antigen, the value of the antigen-binding activity can be represented by the dissociation rate constant (kd), whereas where the antigen is a membrane antigen, such value can be represented by the apparent dissociation rate constant (apparent kd). The dissociation rate constant (kd) and apparent dissociation rate constant (apparent kd) can be determined by known methods, for example, by using the BIACORE (GE healthcare) or a flow cytometer.

In one embodiment, methods for producing or screening for pH-dependent antigen-binding domains or pH-dependent antibodies whose antigen-binding activity is higher under a neutral pH condition than under an acidic pH condition, or libraries thereof, are not limited. Such methods include, for example, those described in WO2009/125825 (for example, paragraphs 0158-0190).

Such a method may comprise, for example:
(a) determining the antigen-binding activity of an antigen-binding domain or antibody in an acidic pH condition;
(b) determining the antigen-binding activity of an antigen-binding domain or antibody in a neutral pH condition; and
(c) selecting an antigen-binding domain or antibody whose antigen-binding activity is lower in the acidic pH condition than in the neutral pH condition.

Alternatively, the method may comprise, for example:
(a) contacting an antigen with an antigen-binding domain or antibody, or a library thereof, in a neutral pH condition;
(b) incubating an antigen-binding domain or antibody bound to the antigen in step (a) in an acidic pH condition; and
(c) isolating an antigen-binding domain or antibody that dissociated in step (b).

Alternatively, the method may comprise, for example:
(a) contacting an antigen with an antigen-binding domain or antibody, or a library thereof in an acidic pH condition;
(b) selecting an antigen-binding domain or antibody that does not bind to the antigen or has a low antigen-binding ability in step (a);
(c) allowing the antigen to bind to the antigen-binding domain or antibody selected in step (b) in a neutral pH condition; and
(d) isolating an antigen-binding domain or antibody that bound to the antigen in step (c).

Alternatively, the method may comprise, for example:
(a) contacting an antigen-binding domain or antibody, or a library thereof with an antigen-immobilized column in a neutral pH condition;
(b) eluting an antigen-binding domain or antibody bound to the column in step (a) from the column in an acidic pH condition; and
(c) isolating an antigen-binding domain or antibody eluted in step (b).

Alternatively, the method may comprise, for example:
(a) allowing an antigen-binding domain or antibody, or a library thereof to pass through an antigen-immobilized column in an acidic pH condition to collect an antigen-binding domain or antibody eluted without binding to the column;
(b) allowing an antigen-binding domain or antibody collected in step (a) to bind to the antigen in a neutral pH condition; and
(c) isolating an antigen-binding domain or antibody bound to the antigen in step (b).

Alternatively, the method may comprise, for example:
(a) contacting an antigen with an antigen-binding domain or antibody, or a library thereof in a neutral pH condition;
(b) obtaining an antigen-binding domain or antibody bound to the antigen in step (a);
(c) incubating an antigen-binding domain or antibody obtained in step (b) in an acidic pH condition; and
(d) isolating an antigen-binding domain or antibody whose antigen-binding activity in step (c) is weaker than the criterion selected in step (b).

Each step in these various screening methods may be repeated several times, or the steps may be combined. The aforementioned conditions may be suitably selected for the acidic and neutral pH conditions. Desired pH-dependent antigen-binding domains or pH-dependent antibodies can be obtained thereby.

In the context of Disclosure A, in one embodiment, the antigen-binding domains or antibodies as a starting material may be, for example, modified antigen-binding domains or antibodies that have an increased pI as a result of modifying the charge of at least one amino acid residue that can be exposed on their surface. In an alternative embodiment, where amino acids that change the binding activity of an ion concentration-dependent antigen-binding domain are introduced into the sequence, they may be introduced in conjunction with a charge modification of at least one amino acid residue that can be exposed on the surface of the antigen-binding domain or antibody so as to increase the pI.

Alternatively, in the context of present invention A, for example, it is possible to use pre-existing antigen-binding domains or antibodies, pre-existing libraries (phage library, etc.); antibodies prepared from hybridomas obtained by immunizing animals or from B cells of immunized animals, or libraries thereof; or antigen-binding domains, antibodies, or libraries obtained by introducing natural or unnatural amino acid mutations having a side-chain with a pKa of 4.0-8.0 (described below) thereinto (for example, libraries with an increased content of natural or unnatural amino acid mutations with a side-chain pKa of 4.0-8.0, or libraries introduced at specific sites with natural or unnatural amino acid mutations with a side-chain pKa of 4.0-8.0). Such a preferred antigen-binding domain can have, for example, an amino acid sequence in which at least one amino acid residue has been substituted with an amino acid(s) with a side-chain pKa of 4.0-8.0 and/or which has been inserted with amino acid(s) with a side-chain pKa of 4.0-8.0, as described in WO2009/125825.

In one embodiment in the context of Disclosure A, the site at which the mutation of amino acids with a side-chain pKa of 4.0-8.0 is introduced is not limited, and the mutation may be introduced at any site as long as the antigen-binding activity becomes weaker in an acidic pH range than in a neutral pH range (the KD (acidic pH range)/KD (neutral pH range) value is increased or the kd (acidic pH range)/kd (neutral pH range) value is increased) as compared to before substitution or insertion. Where the antibody has a variable region or CDR(s), the site may be within the variable region or CDR(s). The number of amino acids that are substituted or inserted can be appropriately determined by those of ordinary skill in the art; and the number may be one or more. Furthermore, it is possible to delete, add, insert, and/or substitute, or modify other amino acids in addition to the substitution or insertion described above. Substitution with or insertion of amino acids with a side-chain pKa of 4.0-8.0 may be carried out in a random fashion by scanning methods such as histidine scanning, in which histidine is used instead of alanine in alanine scanning known to those of ordinary skill in the art, and/or antibodies whose KD (acidic pH range)/KD (neutral pH range) value or kd (acidic pH range)/kd (neutral pH range) value has increased as compared to before mutation may be selected from among the antigen-binding domains or antibodies that result from random substitution with or insertion mutations of these amino acids, or libraries thereof.

Furthermore, the antigen-binding domains or antibodies may be preferably those whose antigen-binding activity in a neutral pH range before and after these mutations is not significantly reduced, is not substantially reduced, is substantial identical, or is increased; and in other words, those whose activity may be maintained at at least 10% or higher, preferably 50% or higher, still more preferably 80% or higher, and yet more preferably 90% or higher, or even higher. Where the binding activity of an antigen-binding domain or antibody is decreased due to substitution with or insertion of amino acids with a pKa of 4.0-8.0, the binding activity may be recovered or increased by e.g., substituting, deleting, adding, or inserting one or more amino acids at sites other than the substitution or insertion sites described above.

In an alternative embodiment, amino acids with a side chain pKa of 4.0-8.0 may be placed at any location within the heavy-chain and/or light-chain variable regions that may form an antigen-binding domain. At least one amino acid residue with a side-chain pKa of 4.0-8.0 may be located, for example, in the CDR (one or more of CDR1, CDR2, and CDR3) and/or FR (one or more of FR1, FR2, FR3, and FR4) of the heavy chain and/or light chain. Such amino acid residues include, but are not limited to, amino acid residues at one or more of positions 24, 27, 28, 31, 32, and 34 according to Kabat numbering in the light-chain variable region CDR1; amino acid residues at one or more of positions 50, 51, 52, 53, 54, 55, and 56 according to Kabat numbering in the light-chain variable region CDR2; and/or amino acid residues at one or more of positions 89, 90, 91, 92, 93, 94, and 95A according to Kabat numbering in the light-chain variable region CDR3. Those amino acid residues may be included alone or in combination, as long as the antigen-binding activity of the antibody changes according to the hydrogen ion concentration condition.

In one embodiment within the scope of Disclosure A, an arbitrary amino acid residue can be suitably used as the amino acid residue that changes the antigen-binding activity of the antigen-binding domain or antibody according to the hydrogen ion concentration condition. Specifically, such amino acid residues can include those with a side-chain pKa of 4.0-8.0. Such amino acids having an electron-donating property may include, for example, natural amino acids such as His (H) and Glu (E), and unnatural amino acids such as histidine analogs (US2009/0035836), m-NO2-Tyr (pKa 7.45), 3,5-Br2-Tyr (pKa 7.21), and 3,5-I2-Tyr (pKa 7.38) (Heyl et al., *Bioorg. Med. Chem.* 11(17):3761-3768 (2003)). The amino acid residues may preferably include, for example, amino acids with a side-chain pKa of 6.0-7.0, and in particular His (H).

Within the scope of Disclosure A described herein, unless otherwise specified and unless there are inconsistencies in the context, it is understood that the isoelectric point (pI) may be either a theoretical or an experimentally determined isoelectric point, and it is also referred to as "pI".

The pI value can be determined experimentally, for example, by isoelectric focusing electrophoresis. Meanwhile, the theoretical pI value can be calculated using gene and amino acid sequence analysis software (Genetyx, etc.).

In one embodiment, whether the pI of an antibody with increased pI or an antibody of Disclosure A has been increased as compared to the antibody before modification (a native antibody (for example, a native Ig antibody, preferably a native IgG antibody) or reference antibody (e.g., an antibody before antibody modification, or prior to or during library construction)) can be determined by carrying out, in addition to or instead of the above-described methods, antibody pharmacokinetics test using plasma, for example, from mice, rats, rabbits, dogs, monkeys, or humans, in combination with methods such as BIACORE, cell proliferation assay, ELISA, enzyme immunoassay (EIA), radioimmunoassay (RIA), or fluorescent immunoassay.

Within the scope of Disclosure A described herein, an "amino acid residue that can be exposed on the surface" generally can refer to an amino acid residue located on the surface of a polypeptide constituting an antibody. An "amino acid residue located on the surface of a polypeptide" can refer to an amino acid residue whose side chain can be in contact with solvent molecules (which in general may be mostly water molecules). However, the side chain does not necessarily have to be wholly in contact with solvent molecules, and when even a portion of the side chain is in contact with the solvent molecules, the amino acid residue is defined as an "amino acid located on the surface". The amino acid residues located on the surface of a polypeptide can also include amino acid residues located close to the antibody surface and thereby can have a mutual electric charge influence from other amino acid residue(s) whose side chain, even partly, is in contact with the solvent molecules. Those of ordinary skill in the art can prepare a homology model of a polypeptide or antibody by for example homology modeling using commercially available softwares. Alternatively, it is possible to use methods such as X-ray crystallography. The amino acid residues that may be exposed on the surface can be determined, for example, using coordinates from a three-dimensional model of an antibody using a computer program such as InsightII program (Accelrys). Surface-exposed sites may be determined using algorithms known in the technical field (for example, Lee and Richards (*J. Mol. Biol.* 55:379-400 (1971)); Connolly (*J. Appl. Cryst.* 16:548-558 (1983)). Surface-exposable sites can be determined using software suitable for protein modeling and three-dimensional structure information obtained from the antibody. Software available for such purposes includes, for example, the SYBYL Biopolymer Module software (Tripos Associates). When an algorithm requires a user input size parameter, the "size" of a probe used in the calculation may be set to about 1.4 Angstrom (Å) or less in radius. Furthermore, methods for determining surface-exposed regions and areas using software for personal computers have been described by Pacios (Pacios, *Comput. Chem* 18(4):377-386 (1994); *J. Mol. Model.* 1:46-53 (1995)). Based on such information as described above, appropriate amino acid residues located on the surface of a polypeptide that constitutes an antibody can be selected.

A method for increasing the pI of a protein is, for example, to reduce the number of amino acids with a negatively charged side chain at a neutral pH condition (for example, aspartic acid and glutamic acid) and/or to increase the number of amino acids with a positively charged side chain (for example, arginine, lysine and histidine). Amino acid residues with a negatively charged side chain have a negative charge represented as −1 at a pH condition that is sufficiently higher than their side chain pKa, which is a theory well known to those of ordinary skill in the art. For example, the theoretical pKa for the side chain of aspartic acid is 3.9, and the side chain has a negative charge represented as −1 at a neutral pH condition (for example, in a solution of pH 7.0). Conversely, amino acid residues with a positively charged side chain have a positive charge represented as +1 at a pH condition that is sufficiently lower than their side chain pKa. For example, the theoretical pKa for the side chain of arginine is 12.5, and the side chain has a positive charge represented as +1 at a neutral pH condition (for example, in a solution of pH 7.0). Amino acid residues whose side chain has no charge at a neutral pH condition (for example, in a solution of pH 7.0) are known to include 15 types of natural amino acids, i.e., alanine, cysteine, phenylalanine, glycine, isoleucine, leucine, methionine, asparagine, proline, glutamine, serine, threonine, valine, tryptophan, and tyrosine. As a matter of course, it is understood that amino acids for changing the pI may be unnatural amino acids.

From the above, as a method for increasing the pI of a protein at a neutral pH condition (for example, in a solution of pH 7.0), a charge alteration of +1 can be conferred to a protein of interest, for example, by substituting amino acids (residues) with non-charged side chains for aspartic acid (residue) or glutamic acid (residue) (whose side chain has a negative charge of −1) in the amino acid sequence of the protein. Furthermore, a charge alteration of +1 can be conferred to the protein, for example, by substituting arginine or lysine (whose side chain has a positive charge of +1) for amino acid (residue) whose side chain has no charge. Moreover, a charge alteration of +2 can be conferred at a time to the protein by substituting arginine or lysine (whose side chain has a positive charge of +1) for aspartic acid or glutamic acid (whose side chain has a negative charge of −1). Alternatively, to increase the pI of a protein, amino acids with a side chain having no charge and/or amino acids having a positively charged side chain can be added or inserted into the amino acid sequence of the protein, or amino acids with a side chain having no charge and/or amino acids with a negatively charged side chain present in the amino acid sequence of the protein can be deleted. It is understood that, for example, the N-terminal and C-terminal amino acid residues of a protein have a main chain-derived charge ($NH^{3+}$ of the amino group at the N-terminus and $COO^-$ of the carbonyl group at the C-terminus) in addition to their side chain-derived charges. Thus, the pI of a protein can also be increased by performing to the main chain-derived functional groups some addition, deletion, substitution, or insertion.

Those of ordinary skill in the art would appreciate that the effect of changing the net charge or pI of a protein, which is obtained by modifying one or more amino acids (residues) in the amino acid sequence with a focus on the presence or magnitude of electrical charges of the amino acids (residues), does not exclusively (or substantially) depend on the antibody-constituting amino acid sequences per se or the type of target antigen, but rather depends on the type and number of amino acid residues that are added, deleted, substituted, or inserted.

Antibodies which have been modified to have an increased pI by modification on at least one amino acid residue that can be exposed on the antibody surface ("antibodies with increased pI" or "pI-increased antibodies") can be taken up more rapidly into cells or can promote antigen elimination from the plasma, as described or suggested in, for example, WO2007/114319, WO2009/041643, WO2014/145159, or WO2012/016227.

Of the several antibody isotypes, for example, the IgG antibody has a sufficiently large molecular weight, and thus its major metabolic pathway is not through renal excretion. The IgG antibody, which has an Fc region as a part of the molecule, is known to be recycled through a salvage pathway via FcRn, and thus has a long in vivo half-life. The IgG antibody is assumed to be mainly metabolized via a metabolic pathway in endothelial cells (He et al., *J. Immunol.* 160(2):1029-1035 (1998)). Specifically, it is believed that when taken up into endothelial cells nonspecifically, IgG antibodies are recycled by binding to FcRn, while IgG antibodies that could not bind are metabolized. The plasma half-life of an IgG antibody may be shortened when its Fc region is modified such that its FcRn-binding activity is reduced. On the other hand, the plasma half-life of an antibody with an increased pI has been demonstrated to depend on the pI in a highly correlated manner, as described in e.g., WO2007/114319 and WO2009/041643. Specifically, the plasma half-life of the pI-increased antibodies described in the above documents was reduced without modifying the amino acid sequence constituting Fc which could potentially lead to acquisition of immunogenicity, and this result suggests that the pI-increasing technology is widely applicable even to any types of antibody molecules whose main metabolic pathway is renal excretion, such as scFv, Fab, or Fc fusion proteins.

The pH concentration in biological fluids (for example, plasma) is in a neutral pH range. Without being bound by a particular theory, it is believed that in biological fluids, the net positive charge of a pI-increased antibody is increased due to the increased pI, and as a result the antibody is more strongly attracted by physicochemical Coulomb interaction to the endothelial cell surface whose net charge is negative, when compared to antibodies whose pI has not been increased; via non-specific binding, the antibody binds thereto and is taken up into cells, which results in shortening of the antibody half-life in plasma or enhancement of antigen elimination from plasma. Furthermore, increasing the pI of an antibody enhances uptake into cells of the antibody (or antigen/antibody complex) and/or intracellular permeability, which is considered to result in reducing the antibody concentration in plasma, reducing the antibody bioavailability, and/or shortening the antibody half-life in plasma; and these phenomena are expected to occur commonly in vivo, regardless of cell type, tissue type, organ type, etc. Furthermore, where an antibody forms a complex with an antigen and is taken up into cells, not only the antibody's pI but also the antigen's pI can have an influence on the decrease or increase of the uptake into cells.

In one embodiment, methods for producing or screening for antibodies with an increased pI may include, for example, those described in WO2007/114319 (for example, paragraphs 0060-0087), WO2009/041643 (for example, paragraph 0115), WO2014/145159, and WO2012/016227. Such a method may comprise, for example:

(a) modifying a nucleic acid that encodes an antibody comprising at least one amino acid residue that can be exposed on the antibody surface such that the charge of the amino acid residue(s) is modified so as to increase the pI of the antibody;
(b) culturing a host cell such that the nucleic acid is expressed; and
(c) collecting an antibody from the host cell culture.

Alternatively, the method may comprise, for example:

(a') modifying a nucleic acid that encodes an antibody comprising at least one amino acid residue that can be exposed on the antibody surface such that the charge of the amino acid residue(s) is modified;

(b') culturing a host cell such that the nucleic acid is expressed;

(c') collecting an antibody from the host cell culture; and (d') (optionally confirming or measuring and) selecting an antibody with a pI increased as compared to an antibody before the modification. Here, the antibody as a starting material or the antibody before the modification or the reference antibody may be, for example, an ion concentration-dependent antibody. Alternatively, when modifying the amino acid residue(s), amino acid(s) that change the binding activity of the ion concentration-dependent antigen-binding domain may also be included in the sequence.

Alternatively, the method may simply be a method that comprises culturing the host cells obtained in step (b) or (b') and collecting an antibody from the cell culture.

In an alternative embodiment, the method may be, for example, a method for producing a multispecific antibody that comprises a first polypeptide and a second polypeptide, and optionally a third polypeptide and a fourth polypeptide, which comprises:

(A) modifying nucleic acid(s) that encodes the first polypeptide and/or the second polypeptide, and optionally the third polypeptide and/or the fourth polypeptide, any one or more of which comprises at least one amino acid residue that can be exposed on the polypeptide surface such that the charge of the amino acid residue(s) is modified so as to increase the antibody's pI;

(B) culturing a host cell such that the nucleic acid is expressed; and (C) collecting a multispecific antibody from the host cell culture.

Alternatively, the method may comprise, for example:

(A') modifying nucleic acid(s) that encodes the first polypeptide and/or the second polypeptide, and optionally the third polypeptide and/or the fourth polypeptide, any one or more of which comprises at least one amino acid residue that can be exposed on the polypeptide surface such that the charge of the amino acid residue(s) is altered;

(B') culturing a host cell such that the nucleic acid is expressed;

(C') collecting a multispecific antibody from the host cell culture; and (D') (optionally confirming and) selecting an antibody whose pI is increased as compared to an antibody before the modification.

Here, the antibody as a starting material or the antibody before the modification or the reference antibody may be, for example, an ion concentration-dependent antibody. Alternatively, when modifying the amino acid residue(s), amino acid(s) that change the binding activity of the ion concentration-dependent antigen-binding domain may also be included in the sequence.

Alternatively, the method may simply be a method that comprises culturing the host cells obtained in step (B) or (B') and collecting an antibody from the cell culture. In this case, the polypeptides whose nucleic acid(s) is to be modified may be preferably a homomultimer of the first polypeptide, a homomultimer of the second polypeptide, or a heteromultimer of the first and second polypeptides (and optionally, a homomultimer of the third polypeptide, a homomultimer of the fourth polypeptide, or a heteromultimer of the third and fourth polypeptides).

In an alternative embodiment, the method may be, for example, a method for producing a humanized or human antibody with shortened half-life in plasma, which comprises: in an antibody which comprises CDR(s) selected from the group consisting of human-derived CDR(s), CDR(s) derived from an animal other than human, and synthetic CDR(s); human-derived FR(s); and a human constant region, (I) modifying at least one amino acid residue that can be exposed on the surface of at least one region selected from the group consisting of the CDR(s), FR(s), and constant region into amino acid residue(s) that has a different charge from the amino acid residue(s) present at the corresponding position(s) before the modification such that the pI of the antibody is increased.

Alternatively, the method may comprise, for example, in an antibody which comprises CDR(s) selected from the group consisting of human-derived CDR(s), CDR(s) derived from an animal other than human, and synthetic CDR(s); human-derived FR(s); and a human constant region, (I') modifying at least one amino acid residue that can be exposed on the surface of at least one region selected from the group consisting of the CDR(s), FR(s), and constant region into amino acid residue(s) that has a different charge from the amino acid residue(s) present at the corresponding position(s) before the modification; and (II') (optionally confirming and) selecting an antibody whose pI is increased as compared to an antibody before the modification.

Here, the antibody as a starting material or the antibody before the modification or the reference antibody may be, for example, an ion concentration-dependent antibody. Alternatively, when modifying the amino acid residue(s), amino acid(s) that change the binding activity of the ion concentration-dependent antigen-binding domain may also be included in the sequence.

Alternatively, for example, it is possible to use pre-existing antigen-binding domains or antibodies, pre-existing libraries (phage library, etc.); antibodies prepared from hybridomas obtained by immunizing animals or from B cells of immunized animals, or libraries thereof; or antigen-binding domains or antibodies or libraries thereof with increased pI, prepared by modifying, in the above-described antigen-binding domains, antibodies, or libraries thereof, at least one amino acid residue that can be exposed on the surface according to for example any one of the above-described embodiments.

In one embodiment of the antibodies of Disclosure A, the pI value may be preferably increased, for example, at least by 0.01, 0.03, 0.05, 0.1, 0.2, 0.3, 0.4, 0.5, or more, or at least by 0.6, 0.7, 0.8, 0.9, or more, and to significantly shorten the antibody half-life in plasma, the pI value may be increased, for example, by at least by 1.0, 1.1, 1.2, 1.3, 1.4, 1.5, or more, or at least by 1.6, 1.7, 1.8, 1.9, 2.0, 2.1, 2.2, 2.3, 2.4, 2.5, or more, or by 3.0 or more, as compared to the antibodies before modification or alteration (native antibodies (for example, native Ig antibodies, preferably native IgG antibodies), or reference or parent antibodies (e.g., antibodies before antibody modification, or prior to or during library construction)). Those of ordinary skill in the art can appropriately routinely determine the optimal pI value for the antibodies of Disclosure A, in consideration of the balance between their pharmacological effect and toxicity, and for example, the number of antigen-binding domains of the antibodies or the pI of the antigen according to the purpose. Without being bound by a particular theory, it is believed that antibodies of Disclosure A, in one embodiment, are beneficial because, in addition to the characteristic of being shuttled between plasma and cellular endosomes and repeated binding to multiple antigens with one single antibody molecule due to the presence of an ion concentration-dependent antigen-binding domain, the antibody's net positive charge is increased as a result of increase in pI and this allows rapid cellular uptake of the antibody. These characteristics would shorten the antibody half-life in plasma, increase the extracellular matrix-binding activity of the antibodies, or enhance antigen elimination from plasma. One may decide on the optimal pI value to take advantage of these characteristics.

In one embodiment in the context of Disclosure A, when compared to the antibodies before modification or alteration of at least one amino acid residue to increase the pI (native antibodies (for example, native Ig antibodies, preferably native IgG antibodies), or reference or parent antibodies (e.g., antibodies before antibody modification, or prior to or during library construction), which can be ion concentration-dependent antibodies), the ion concentration-dependent antibodies of Disclosure A with increased pI may preferably enhance antigen elimination from plasma, for example, by at least 1.1-fold, 1.25-fold, 1.5-fold, 1.75-fold, 2-fold, 2.25-fold, 2.5-fold, 2.75-fold, 3-fold, 3.25-fold, 3.5-fold, 3.75-fold, 4-fold, 4.25-fold, 4.5-fold, 4.75-fold, 5-fold, 5.5-fold, 6-fold, 6.5-fold, 7-fold, 7.5-fold, 8-fold, 8.5-fold, 9-fold, 9.5-fold, or 10-fold or more (when the antibodies are administered in vivo), or their extracellular matrix-binding activity may be preferably increased, for example, by at least 1.1-fold, 1.25-fold, 1.5-fold, 1.75-fold, 2-fold, 2.25-fold, 2.5-fold, 2.75-fold, 3-fold, 3.25-fold, 3.5-fold, 3.75-fold, 4-fold, 4.25-fold, 4.5-fold, 4.75-fold, or 5-fold or more.

In one embodiment in the context of Disclosure A, when compared to the antibodies before introduction of an ion concentration-dependent antigen-binding domain (native antibodies (for example, native Ig antibodies, preferably native IgG antibodies), or reference or parent antibodies (e.g., antibodies before antibody modification, or prior to or during library construction), which can be antibodies with an increased pI), the ion concentration-dependent antibodies of Disclosure A with increased pI may preferably enhance antigen elimination from plasma, for example, by at least 1.1-fold, 1.25-fold, 1.5-fold, 1.75-fold, 2-fold, 2.25-fold, 2.5-fold, 2.75-fold, 3-fold, 3.25-fold, 3.5-fold, 3.75-fold, 4-fold, 4.25-fold, 4.5-fold, 4.75-fold, 5-fold, 5.5-fold, 6-fold, 6.5-fold, 7-fold, 7.5-fold, 8-fold, 8.5-fold, 9-fold, 9.5-fold, or 10-fold or more (when the antibodies are administered in vivo), or their extracellular matrix-binding activity may be preferably increased, for example, by at least 1.1-fold, 1.25-fold, 1.5-fold, 1.75-fold, 2-fold, 2.25-fold, 2.5-fold, 2.75-fold, 3-fold, 3.25-fold, 3.5-fold, 3.75-fold, 4-fold, 4.25-fold, 4.5-fold, 4.75-fold, or 5-fold or more.

In one embodiment, assay methods for assessing whether the extracellular matrix-binding activity of antibodies of Disclosure A has been increased as compared to the antibodies before modification or alteration (native antibodies (for example, native Ig antibodies, which can be native IgG antibodies), or reference or parent antibodies (e.g., antibodies before antibody modification, or prior to or during library construction), which can be ion concentration-dependent antibodies or antibodies with an increased pI) are not limited. For example, the assay can be carried out using an ELISA system which detects the binding between an antibody and an extracellular matrix, where an antibody is added to an extracellular matrix-immobilized plate, and a labeled antibody against the antibody is added thereto. Alternatively, as described in Examples 1 to 4 herein and in WO2012/093704, it is also possible to use electrochemiluminescence (ECL) which enables high sensitivity detection of the extracellular matrix-binding ability. This method can be performed, for example, using an ECL system in which a mixture of an antibody and a ruthenium antibody is added to an extracellular matrix-immobilized plate and the binding between the antibodies and the extracellular matrix is measured based on the electrochemiluminescence of ruthenium. The concentration of the antibody to be added can be set appropriately; the added concentration can be high in order to increase the sensitivity for detecting extracellular matrix binding. Such extracellular matrices may be derived from animals or plants, as long as they contain glycoproteins such as collagen, proteoglycan, fibronectin, laminin, entactin, fibrin, and perlecan; and animal-derived extracellular matrices may be preferred. For example, it is possible to use extracellular matrices derived from animals such as humans, mice, rats, monkeys, rabbits, or dogs. For example, a human-derived native extracellular matrix may be used as an indicator of antibody pharmacodynamics in human plasma. The condition for assessing extracellular matrix-binding of an antibody may be preferably a neutral pH range around pH 7.4, which is the physiological condition; however, the condition does not necessarily have to be a neutral range, and the binding may also be assessed in an acidic pH range (for example, around pH 6.0). Alternatively, when assessing the extracellular matrix-binding of an antibody, the assay can be performed in the co-presence of an antigen molecule to which the antibody binds and by assessing the binding activity of the antigen-antibody complex toward the extracellular matrix.

In one embodiment, antibodies of Disclosure A (substantially) can retain the antigen-binding activity when compared to the antibodies before modification or alteration of at least one amino acid residue to increase pI (native antibodies (for example, native Ig antibodies, preferably native IgG antibodies) or reference antibodies (e.g., antibodies before antibody modification, or prior to or during library construction)). In this case, "to (substantially) retain the antigen-binding activity" can mean to have an activity of at least 50% or more, preferably 60% or more, more preferably 70% or 75% or more, and still more preferably 80%, 85%, 90%, or 95% or more as compared to the binding activity of the antibodies before modification or alteration. Alternatively, antibodies of Disclosure A only need to retain binding activity to a degree that allows them to retain their functions when they bind to antigens; thus, the affinity determined at 37° C. under the physiological conditions may be, for example, 100 nM or less, preferably 50 nM or less, more preferably 10 nM or less, and still more preferably 1 nM or less.

In one embodiment of Disclosure A, the expression of "modification of at least one amino acid residue that can be exposed on the antibody surface" or an equivalent expression can mean that one or more of addition, deletion, substitution and insertion are performed on at least one amino acid residue that can be exposed on the surface of an antibody. Such modification may preferably include substitution of at least one amino acid residue.

The substitution of amino acid residues can include, for example, substitution of amino acid residues whose side chain has no charge for amino acid residues having a negatively charged side chain, substitution of amino acid residues having a positively charged side chain for amino acid residues whose side chain has no charge, and substitution of amino acid residues having a positively charged side chain for amino acid residues having a negatively charged side chain in the amino acid sequence of an antibody of interest, which can be performed alone or in appropriate combinations. The insertion or addition of amino acid residues can include, for example, insertion or addition of amino acids whose side chain has no charge and/or insertion or addition of amino acids having a positively charged side chain in the amino acid sequence of an antibody of interest, which can be performed alone or in appropriate combinations. The deletion of amino acid residues can include, for example, deletion of amino acid residues whose side chain has no charge and/or deletion of amino acid residues having a negatively charged side chain in the amino acid sequence of an antibody of interest, which can be performed alone or in appropriate combinations.

Those of ordinary skill in the art can appropriately combine one of more of these addition, deletion, substitution, and insertion in the amino acid sequence of an antibody of interest. Modification that causes a reduction in the local charge of amino acid residues is also acceptable since the net pI of an antibody of Disclosure A only has to be increased. For example, if desired, antibodies whose pI has been increased (too much) may be modified to decrease the pI (slightly). It is also acceptable that the local charge of amino acid residues is decreased as a result of modification of at least one amino acid residue carried out simultaneously or at a different time for other purposes (for example, to increase antibody stability or to reduce immunogenicity). Such antibodies include antibodies from libraries constructed for specific purposes.

In one embodiment, among amino acids (residues) used for modifying at least one amino acid residue that can be exposed on the antibody surface, natural amino acids are as follows: an amino acid with a negatively charged side chain can be Glu (E) or Asp (D); an amino acid whose side chain has no charge can be Ala (A), Asn (N), Cys (C), Gln (Q), Gly (G), His (H), Ile (I), Leu (L), Met (M), Phe (F), Pro (P), Ser (S), Thr (T), Trp (W), Tyr (Y), or Val (V); and an amino acid with a positively charged side chain can be His (H), Lys (K), or Arg (R).

As described in detail in Examples 1 to 4 herein, in a solution of neutral pH (for example, pH 7.0), lysine and arginine have a positive charge in almost 100% when present as a residue in an antibody, while histidine has a positive charge in only about 9% when present as a residue in an antibody and the remaining major portion is assumed not to have any charge. Thus, Lys (K) or Arg(R) is preferably selected as an amino acid with a positively charged side chain.

In one embodiment, antibodies of Disclosure A preferably has a variable region and/or a constant region. Furthermore, the variable region may preferably have a heavy chain variable region and/or a light chain variable region, and/or may preferably have CDR(s) (for example, one or more of CDR1, CDR2, and CDR3) and/or FR(s) (for example, one or more of FR1, FR2, FR3, and FR4). The constant region may preferably have a heavy chain constant region and/or a light chain constant region, and in terms of the sequence and type, it may be, for example, an IgG-type constant region (preferably, human IgG1, human IgG2, human IgG3, or human IgG4-type constant region, human κ chain constant region, and human λ chain constant region). It is also possible to use modified variants of these constant regions.

In one embodiment, the modification of at least one amino acid residue that can be exposed on the antibody surface may be either a modification of a single amino acid or a combination of modifications of multiple amino acids. A preferred method can be to introduce a combination of multiple amino acid substitutions at sites where amino acids can be exposed on the antibody surface. Furthermore, without limitations, such multiple amino acid substitutions are preferably introduced at positions that are three-dimensionally close to one another. When amino acids with a positively charged side chain (for example, Lys (K) or Arg (R)) have been substituted for amino acids that can be exposed on the surface of an antibody molecule (which are preferably, but are not limited to, amino acids with a negatively charged side chain (for example, Glu (E) or Asp (D)); or when pre-existing amino acids having a positively charge (for example, Lys (K) or Arg (R)) are used, for example, one or more amino acids (which may include amino acids embedded inside the antibody molecule depending on the situation) that are three-dimensionally close to the amino acids may also be substituted with amino acids having a positively charge to consequently create a dense state of local positive charge in a three-dimensionally proximal location. Herein, the definition of "a three-dimensionally proximal location" is not particularly limited; but it can mean a state where one or more amino acid substitution is introduced, for example, within 20 Å, preferably within 15 Å, and more preferably within 10 Å. Whether an amino acid substitution site of interest is exposed on the surface of an antibody molecule or whether an amino acid substitution site is close to other amino acid substitution site(s) or the above pre-existing amino acids can be assessed by known methods such as X-ray crystallography.

In addition to those described above, methods for giving multiple positive charges at sites three-dimensionally close to one another can include those that use amino acids that originally have a positive charge in the native IgG constant region. Such amino acids include, for example: arginine at positions 255, 292, 301, 344, 355, and 416, according to EU numbering; and lysine at positions 121, 133, 147, 205, 210, 213, 214, 218, 222, 246, 248, 274, 288, 290, 317, 320, 322, 326, 334, 338, 340, 360, 370, 392, 409, 414, and 439, according to EU numbering. Multiple positive charges can be given into a three-dimensionally proximal location by substituting with positively charged amino acid(s) at sites three-dimensionally close to these positively charged amino acids.

Where antibodies of Disclosure A have a variable region (that may be modified), amino acid residues that are not masked by antigen binding (i.e., that still can be exposed on the surface) may be modified, and/or amino acid modification may not be introduced at sites that are masked by antigen binding or amino acid modification that does not (substantially) inhibit antigen binding may be carried out. Where amino acid residues that can be exposed on the surface of an antibody molecule present in the ion concentration-dependent binding domain are modified, amino acids of the antigen-binding domain may be modified in such a way that the modification does not (substantially) reduce the binding activity of amino acid residues that can change the antigen-binding activity of the antibody according to the ion concentration condition (for example, those in a calcium-binding motif, or a histidine insertion site and/or a histidine substituted site), or amino acid residues may be modified at sites other than of the amino acid residues that can change the antigen-binding activity of the antibody according to the ion concentration condition. On the other hand, where amino acid residues that can be exposed on the surface of an antibody molecule present in the ion concentration-dependent binding domain have already been modified, the type or the position of amino acid residues that can change the antigen-binding activity of the antibody according to the ion concentration condition may be selected such that the pI of the antibody is not reduced below an acceptable level. Where the pI of an antibody is reduced below an acceptable level, the pI of the overall antibody can be increased by modifying at least one amino acid residue that can be exposed on the surface of the antibody molecule.

Without limitations, FR sequences with a high pI may be preferably selected from human germline FR sequences or sequences of regions that are equivalent thereto, whose amino acid may be modified in some cases.

Where antibodies of Disclosure A have a constant region (that may be modified) having an FcγR-binding domain (which may be a binding domain to any of the FcγR isoforms and allotypes described below) and/or an FcRn-binding domain, sites for modification of at least one amino acid residue that can be exposed on the surface of the constant region can be amino acid residues other than those in the FcγR-binding domain and/or those in the FcRn-binding domain, if desired. Alternatively, where the modification sites are selected from amino acid residues in the FcγR-binding domain and/or in the FcRn-binding domain, it may be preferable to select sites that do not (substantially) affect the binding activity or binding affinity for FcγR and/or FcRn, or if they would affect, sites which is biologically or pharmacologically acceptable.

In one embodiment, the site of the at least one amino acid residue that is modified to produce an antibody of Disclosure A whose pI is increased by modification of at least one amino acid residue that can be exposed on the surface of the variable region (that may be modified) is not limited; however, such a site can be selected from the group consisting of, according to Kabat numbering: (a) position 1, 3, 5, 8, 10, 12, 13, 15, 16, 18, 19, 23, 25, 26, 39, 41, 42, 43, 44, 46, 68, 71, 72, 73, 75, 76, 77, 81, 82, 82a, 82b, 83, 84, 85, 86, 105, 108, 110, and 112 in a FR of the heavy chain variable region; (b) position 31, 61, 62, 63, 64, 65, and 97 in a CDR of the heavy chain variable region; (c) position 1, 3, 7, 8, 9, 11, 12, 16, 17, 18, 20, 22, 37, 38, 39, 41, 42, 43, 45, 46, 49, 57, 60, 63, 65, 66, 68, 69, 70, 74, 76, 77, 79, 80, 81, 85, 100, 103, 105, 106, 107, and 108 in a FR of the light chain variable region; and (d) position 24, 25, 26, 27, 52, 53, 54, 55, and 56 in a CDR of the light chain variable region, wherein an amino acid at each position after modification can be selected from any of the amino acids described above in terms of the side-chain charge such as Lys (K), Arg (R), Gln (Q), Gly (G), Ser (S), or Asn (N), but is not limited thereto. In some embodiments, at least 2, 3, 4, 5, 6, 7, 8, 9, 10 or more than 10 of the above amino acid positions are modified. In some embodiments, 1-20, 1-15, 1-10, or 1-5 of the above amino acid positions are modified.

In one embodiment, among the position(s) to be modified, the following position(s) can be used for aiding in pI increase of an antibody of Disclosure A, in combination with other position(s) which themselves can have sufficient effect of increasing pI of an antibody. Such position(s) for aiding in the pI increase can be, for example, as for a light chain variable region, selected from a group consisting of positions 27, 52, 56, 65, and 69, according to Kabat numbering.

Furthermore, the site of at least one amino acid residue that is modified in the CDR and/or FR is not limited; however, such a site can be selected from the group consisting of: (a) position 8, 10, 12, 13, 15, 16, 18, 23, 39, 41, 43, 44, 77, 82, 82a, 82b, 83, 84, 85, and 105 in the FR of the heavy chain variable region; (b) position 31, 61, 62, 63, 64, 65, and 97 in the CDR of the heavy chain variable region; (c) position 16, 18, 37, 41, 42, 45, 65, 69, 74, 76, 77, 79, and 107 in the FR of the light chain variable region; and (d) position 24, 25, 26, 27, 52, 53, 54, 55, and 56 in the CDR of the light chain variable region. In some embodiments, at least 2, 3, 4, 5, 6, 7, 8, 9, 10 or more than 10 of the above amino acid positions are modified. In some embodiments, 1-20, 1-15, 1-10, or 1-5 of the above amino acid positions are modified.

Where the modification site of at least one amino acid residue is selected, for example, from a group comprising the above-described groups, the type of amino acid after modification in the heavy-chain variable region is, for example:

(a) 8K, 8R, 8Q, 8G, 8S, or 8N for position 8; (b) 13K, 13R, 13Q, 13G, 13S, or 13N for position 13; (c) 15K, 15R, 15Q, 15G, 15S, or 15N for position 15; (d) 16K, 16R, 16Q, 16G, 16S, or 16N for position 16; (e) 18K, 18R, 18Q, 18G, 18S, or 18N for position 18; (f) 39K, 39R, 39Q, 39G, 39S, or 39N for position 39; (g) 41K, 41R, 41Q, 41G, 41S, or 41N for position 41; (h) 43K, 43R, 43Q, 43G, 43S, or 43N for position 43; (i) 44K, 44R, 44Q, 44G, 44S, or 44N for position 44; (j) 63K, 63R, 63Q, 63G, 63S, or 63N for position 63; (k) 64K, 64R, 64Q, 64G, 64S, or 64N for position 64; (l) 77K, 77R, 77Q, 77G, 77S, or 77N for position 77; (m) 82K, 82R, 82Q, 82G, 82S, or 82N for position 82; (n) 82aK, 82aR, 82aQ, 82aG, 82aS, or 82aN for position 82a; (o) 82bK, 82bR, 82bQ, 82bG, 82bS, or 82bN for position 82b; (p) 83K, 83R, 83Q, 83G, 83S, or 83N for position 83; (q) 84K, 84R, 84Q, 84G, 84S, or 84N for position 84; (r) 85K, 85R, 85Q, 85G, 85S, or 85N for position 85; or (s) 105K, 105R, 105Q, 105G, 105S, or 105N for position 105. In some embodiments, at least 2, 3, 4, 5, 6, 7, 8, 9, 10 or more than 10 of any combination of the above amino acid positions are modified. In some embodiments, 1-20, 1-15, 1-10, or 1-5 of any combination of the above amino acid positions are modified.

Non-limiting examples of a combination of modified amino acids positions in the heavy-chain variable region is, for example:

any two or more of positions selected from the group consisting of positions 16, 43, 64, and 105; any two or more of positions selected from the group consisting of positions 77, 82a, and 82b; positions 77 and 85; positions 41 and 44; positions 82a and 82b; positions 82 and 82b; positions 82b and 83; or positions 63 and 64, according to Kabat numbering, wherein an amino acid at each position after modification can be selected from any of the amino acids described above in terms of the side-chain charge such as Lys (K), Arg (R), Gln (Q), Gly (G), Ser (S), or Asn (N), but is not limited thereto.

A specific combination can be, for example, 16Q/43R/64K/105Q; 77R/82aN/82bR; 77R/82aG/82bR; 77R/82aS/82bR; 77R/85G; 41R/44R; 82aN/82bR; 82aG/82bR; 82aS/82bR; 82K/82bR; 82bR/83R; 77R/85R; or 63R/64K.

Likewise, the type of amino acid after modification in the light-chain variable region is, for example: (a) 16K, 16R, 16Q, 16G, 16S, or 16N for position 16; (b) 18K, 18R, 18Q, 18G, 18S, or 18N for position 18; (c) 24K, 24R, 24Q, 24G, 24S, or 24N for position 24; (d) 25K, 25R, 25Q, 25G, 25S, or 25N for position 25; (e) 26K, 26R, 26Q, 26G, 26S, or 26N for position 26; (f) 27K, 27R, 27Q, 27G, 27S, or 27N for position 27; (g) 37K, 37R, 37Q, 37G, 37S, or 37N for position 37; (h) 41K, 41R, 41Q, 41G, 41S, or 41N for position 41; (i) 42K, 42R, 42Q, 42G, 42S, or 42N for position 42; (j) 45K, 45R, 45Q, 45G, 45S, or 45N for position 45; (k) 52K, 52R, 52Q, 52G, 52S, or 52N for position 52; (l) 53K, 53R, 53Q, 53G, 53S, or 53N for position 53; (m) 54K, 54R, 54Q, 54G, 54S, or 54N for position 54; (n) 55K, 55R, 55Q, 55G, 55S, or 55N for position 55; (o) 56K, 56R, 56Q, 56G, 56S, or 56N for position 56; (p) 65K, 65R, 65Q, 65G, 65S, or 65N for position 65; (q) 69K, 69R, 69Q, 69G, 69S, or 69N for position 69; (r) 74K, 74R, 74Q, 74G, 74S, or 74N for position 74; (s) 76K, 76R, 76Q, 76G, 76S, or 76N for position 76; (t) 77K, 77R, 77Q, 77G, 77S, or 77N for position 77; (u) 79K, 79R, 79Q, 79G, 79S, or 79N for position 79; and (v) 107K, 107R, 107Q, 107G, 107S, or 107N for position 107. In some embodiments, at least 2, 3, 4, 5, 6, 7, 8, 9, 10 or more than 10 of any combination of the above amino acid positions are modified. In some embodiments, 1-20, 1-15, 1-10, or 1-5 of any combination of the above amino acid positions are modified.

Non-limiting examples of a combination of modified amino acids positions in the light-chain variable region is, for example: positions 24 and 27; positions 25 and 26; positions 41 and 42; positions 42 and 76; positions 52 and 56; positions 65 and 79; positions 74 and 77; positions 76 and 79; any two or more of positions selected from the group consisting of positions 16, 24, and 27; any two or more of positions selected from the group consisting of positions 24, 27, and 37; any two or more of positions selected from the group consisting of positions 25, 26, and 37; any two or more of positions selected from the group consisting of positions 27, 76, and 79; any two or more of positions selected from the group consisting of positions 41, 74, and 77; any two or more of positions selected from the group consisting of positions 41, 76, and 79; any two or more of positions selected from the group consisting of positions 24, 27, 41, and 42; any two or more of positions selected from the group consisting of positions 24, 27, 52, and 56; any two or more of positions selected from the group consisting of positions 24, 27, 65, and 69; any two or more of positions selected from the group consisting of positions 24, 27, 74, and 77; any two or more of positions selected from the group consisting of positions 24, 27, 76, and 79; any two or more of positions selected from the group consisting of positions 25, 26, 52, and 56; any two or more of positions selected from the group consisting of positions 25, 26, 65, and 69; any two or more of positions selected from the group consisting of positions 25, 26, 76, and 79; any two or more of positions selected from the group consisting of positions 27, 41, 74, and 77; any two or more of positions selected from the group consisting of positions 27, 41, 76, and 79; any two or more of positions selected from the group consisting of positions 52, 56, 74, and 77; any two or more of positions selected from the group consisting of positions 52, 56, 76, and 79; any two or more of positions selected from the group consisting of positions 65, 69, 76, and 79; any two or more of positions selected from the group consisting of positions 65, 69, 74, and 77; any two or more of positions selected from the group consisting of positions 18, 24, 45, 79, and 107; any two or more of positions selected from the group consisting of positions 27, 52, 56, 74, and 77; any two or more of positions selected from the group consisting of positions 27, 52, 56, 76, and 79; any two or more of positions selected from the group consisting of positions 27, 65, 69, 74, and 77; any two or more of positions selected from the group consisting of positions 27, 65, 69, 76, and 79; any two or more of positions selected from the group consisting of positions 41, 52, 56, 74, and 77; any two or more of positions selected from the group consisting of positions 41, 52, 56, 76, and 79; any two or more of positions selected from the group consisting of positions 41, 65, 69, 74, and 77; any two or more of positions selected from the group consisting of positions 41, 65, 69, 76, and 79; any two or more of positions selected from the group consisting of positions 24, 27, 41, 42, 65, and 69; any two or more of positions selected from the group consisting of positions 24, 27, 52, 56, 65, and 69; any two or more of positions selected from the group consisting of positions 24, 27, 65, 69, 74, and 77; any two or more of positions selected from the group consisting of positions 24, 27, 65, 69, 76, and 79; any two or more of positions selected from the group consisting of positions 24, 27, 41, 42, 74, and 77; any two or more of positions selected from the group consisting of positions 24, 27, 52, 56, 74, and 77; any two or more of positions selected from the group consisting of positions 24, 27, 41, 42, 76, and 79; any two or more of positions selected from the group consisting of positions 24, 27, 52, 56, 76, and 79; any two or more of positions selected from the group consisting of positions 24, 27, 74, 76, 77, and 79; any two or more of positions selected from the group consisting of positions 52, 56, 65, 69, 74, and 77; or any two or more of positions selected from the group consisting of positions 52, 56, 65, 69, 76, and 79, according to Kabat numbering, wherein an amino acid at each position after modification can be selected from any of the amino acids described above in terms of the side-chain charge such as Lys (K), Arg (R), Gln (Q), Gly (G), Ser (S), or Asn (N), but is not limited thereto.

A specific combination can be, for example, 24R/27Q; 24R/27R; 24K/27K; 25R/26R; 25K/26K; 41R/42K; 42K/76R; 52R/56R; 65R/79K; 74K/77R; 76R/79K; 16K/24R/27R; 24R/27R/37R; 25R/26R/37R; 27R/76R/79K; 41R/74K/77R; 41R/76R/79K; 24R/27R/41R/42K; 24R/27R/52R/56R; 24R/27R/52K/56K; 24R/27R/65R/69R; 24R/27R/74K/77R; 24R/27R/76R/79K; 25R/26R/52R/56R; 25R/26R/52K/56K; 25R/26R/65R/69R; 25R/26R/76R/79K; 27R/41R/74K/77R; 27R/41R/76R/79K; 52R/56R/74K/77R; 52R/56R/76R/79K; 65R/69R/76R/79K; 65R/69R/74K/77R; 18R/24R/45K/79Q/107K; 27R/52R/56R/74K/77R; 27R/52R/56R/76R/79K; 27R/65R/69R/74K/77R; 27R/65R/69R/76R/79K; 41R/52R/56R/74K/77R; 41R/52R/56R/76R/79K; 41R/65R/69R/74K/77R; 41R/65R/69R/76R/79K; 24R/27R/41R/42K/65R/69R; 24R/27R/52R/56R/65R/69R; 24R/27R/65R/69R/74K/77R; 24R/27R/65R/69R/76R/79K; 24R/27R/41R/42K/74K/77R; 24R/27R/52R/56R/74K/77R; 24R/27R/41R/42K/76R/79K; 24R/27R/52R/56R/76R/79K; 24R/27R/74K/76R/77R/79K; 52R/56R/65R/69R/74K/77R; or 52R/56R/65R/69R/76R/79K.

In WO2007/114319 or WO2009/041643, it has already been explained or demonstrated based on theoretical evidence, homology modeling, or experimental techniques that the effect of increasing the pI via modification of some amino acid residues in the variable region does not exclusively (or substantially) depend on the antibody-constituting amino acid sequences per se or the type of target antigen, but rather it depends on the type and number of amino acid residues that are substituted. It has been also demonstrated that even after modification of some amino acids, the antigen-binding activity for several types of antigens is (substantially) maintained, or at least can be expected to be maintained with high possibility by those of ordinary skill in the art.

For example, WO2009/041643 specifically shows that in the heavy-chain FR of a humanized glypican 3 antibody as shown in SEQ ID NO:8, preferred modification sites of amino acid residues that can be exposed on the surface are positions 1, 3, 5, 8, 10, 12, 13, 15, 16, 19, 23, 25, 26, 39, 42, 43, 44, 46, 69, 72, 73, 74, 76, 77, 82, 85, 87, 89, 90, 107, 110, 112, and 114 according to Kabat numbering. It also reports that the amino acid residue at position 97 according to Kabat numbering is preferred because it is exposed on the surface of almost all antibodies. WO2009/041643 also shows that the amino acid residues of positions 52, 54, 62, 63, 65, and 66 in the heavy-chain CDR of the antibody are preferred. It also shows that the amino acid residues of positions 1, 3, 7, 8, 9, 11, 12, 16, 17, 18, 20, 22, 43, 44, 45, 46, 48, 49, 50, 54, 62, 65, 68, 70, 71, 73, 74, 75, 79, 81, 82, 84, 85, 86, 90, 105, 108, 110, 111, and 112 according to Kabat numbering in the light-chain FR of a humanized glypican 3 antibody as shown in SEQ ID NO:9 are preferred. It also shows that the amino acid residues of positions 24, 27, 33, 55, 59 in the light-chain CDR of this antibody are preferred. Furthermore, WO2009/041643 specifically shows that the amino acid residues of positions 31, 64, and 65 according to Kabat numbering in the heavy-chain CDR of an anti-human IL-6 receptor antibody as shown in SEQ ID NO:10 are preferred sites that allow modification of amino acid residues that can be exposed on the surface while maintaining the antigen-binding activity. It also shows that the amino acid residues of positions 24, 27, 53, and 55 according to Kabat numbering in the light chain CDR of an anti-human IL-6 receptor antibody as shown in SEQ ID NO:11 are preferred. It also specifically shows that the amino acid residue of position 31 according to Kabat numbering in the heavy-chain CDR of an anti-human IL-6 receptor antibody as shown in SEQ ID NO:12 is a preferred site that allows modification of amino acid residue that can be exposed on the surface while maintaining the antigen-binding activity. It also shows that the amino acid residues of positions 24, 53, 54, and 55 according to Kabat numbering in the light-chain CDR of an anti-human IL-6 receptor antibody as shown in SEQ ID NO:13 are preferred. WO2009/041643 also shows that the amino acid residues of positions 61, 62, 64, and 65 according to Kabat numbering in the heavy-chain CDR of an anti-human glypican 3 antibody as shown in SEQ ID NO:14 are preferred sites that allow modification of amino acid residues that can be exposed on the surface while maintaining the antigen-binding activity. It also shows that the amino acid residues of positions 24 and 27 according to Kabat numbering in the light-chain CDR of an anti-human glypican 3 antibody as shown in SEQ ID NO:15 are preferred. It also shows that the amino acid residues of positions 61, 62, 64, and 65 according to Kabat numbering in the heavy-chain CDR of an anti-human IL-31 receptor antibody as shown in SEQ ID NO:16 are preferred sites that allow modification of amino acid residues that can be exposed on the surface while maintaining the antigen-binding activity. WO2009/041643 also shows that the amino acid residues of positions 24 and 54 according to Kabat numbering in the light-chain CDR of an anti-human IL-31 receptor antibody as shown in SEQ ID NO:17 are preferred. Similarly, WO2007/114319 reports that antibodies hA69-PF, hA69-p18, hA69-N97R, hB26-F123e4, hB26-p15, and hB26-PF, which were produced by modifying the charge of one or more amino acid residues that can be exposed on the surface, showed changes in pI as demonstrated by isoelectric focusing, and had an equivalent binding activity to Factor IXa or Factor X, which are their antigens, compared with that of the antibodies before modification or alteration. It also reports that when these antibodies were administered to mice, the pI of each antibody showed high correlation with their clearance (CL) in plasma, retention time in plasma, and half-life in plasma (T1/2). WO2007/114319 also demonstrates that amino acid residues of positions 10, 12, 23, 39, 43, 97, and 105 in the variable region are preferred as sites for modification of amino acid residues that can be exposed on the surface.

In an alternative or further embodiment, for example, using known methods such as X-ray crystallography or a homology model constructed by homology modeling from an antibody constant region (which is preferably a human constant region, more preferably a human Ig-type constant region, and still more preferably a human IgG-type constant region, but is not limited thereto), amino acid residues that can be exposed on the surface of an antibody constant region may be identified to determine the modification sites of at least one amino acid residue for producing an antibody of Disclosure A whose pI has been increased. The modification site of at least one amino acid residue that can be exposed on the surface of the constant region is not limited; however, the site can be preferably selected from the group consisting of: position 196, 253, 254, 256, 257, 258, 278, 280, 281, 282, 285, 286, 306, 307, 308, 309, 311, 315, 327, 330, 342, 343, 345, 356, 358, 359, 361, 362, 373, 382, 384, 385, 386, 387, 388, 389, 399, 400, 401, 402, 413, 415, 418, 419, 421, 424, 430, 433, 434, and position 443, according to EU numbering, and may be preferably selected from the group consisting of: position 254, 258, 281, 282, 285, 309, 311, 315, 327, 330, 342, 343, 345, 356, 358, 359, 361, 362, 384, 385, 386, 387, 389, 399, 400, 401, 402, 413, 418, 419, 421, 433, 434, and 443, and may be also preferably selected from the group consisting of: positions 282, 309, 311, 315, 342, 343, 384, 399, 401, 402, and 413, whose amino acid at each position after modification can be selected from the amino acids described above in terms of the side-chain charge such as Lys (K), Arg (R), Gln (Q), or Asn (N), but is not limited thereto. When the modification site of at least one amino acid residue is selected, for example, from a group comprising the above-described groups, for example, the type of amino acid after modification at each site can be as follows: 254K, 254R, 254Q, or 254N at position 254; 258K, 258R, 258Q, or 258N at position 258; 281K, 281R, 281Q, or 281N at position 281; 282K, 282R, 282Q, or 282N at position 282; 285K, 285R, 285Q, or 285N at position 285; 309K, 309R, 309Q, or 309N at position 309; 311K, 311R, 311Q, or 311N at position 311; 315K, 315R, 315Q, or 315N at position 315; 327K, 327R, 327Q, or 327N at position 327; 330K, 330R, 330Q, or 330N at position 330; 342K, 342R, 342Q, or 342N at position 342; 343K, 343R, 343Q, or 343N at position 311; 345K, 345R, 345Q, or 345N at position 345; 356K, 356R, 356Q, or 356N at position 356; 358K, 358R, 358Q, or 358N at position 358; 359K, 359R, 359Q, or 359N at position 359; 361K, 361R, 361Q, or 361N at position 361; 362K, 362R, 362Q, or 362N at position 362; 384K, 384R, 384Q, or 384N at position 384; 385K, 385R, 385Q, or 385N at position 385; 386K, 386R, 386Q, or 386N at position 386; 387K, 387R, 387Q, or 387N at position 387; 389K, 389R, 389Q, or 389N at position 389; 399K, 399R, 399Q, or 399N at position 399; 400K, 400R, 400Q, or 400N at position 400; 401K, 401R, 401Q, or 401N at position 401; 402K, 402R, 402Q, or 402N at position 402; 413K, 413R, 413Q, or 413N at position 413; 418K, 418R, 418Q, or 418N at position 418; 419K, 419R, 419Q, or 419N at position 419; 421K, 421R, 421Q, or 421N at position 421; 433K, 433R, 433Q, or 433N at position 433; 434K, 434R, 434Q, or 434N at position 434; and 443K, 443R, 443Q, or 443N at position 443.

In an alternative embodiment, the modification site of at least one amino acid residue and the type of amino acid after modification may include 345R or 345K, and/or 430R, 430K, 430G, or 435T, according to EU numbering.

In one embodiment of the antibodies of Disclosure A, the antibody's net pI may be increased by modifying at least one amino acid residue that can be exposed on the surface of the variable region (which may be modified) as described above and at least one amino acid residue that can be exposed on the surface of the constant region (which may be modified) as described above.

Within the scope of Disclosures A and B described herein, where an antibody of Disclosure A or B is an IgG-type antibody or a molecule derived therefrom, the antibody heavy-chain constant region may contain a constant region of the IgG1 type, IgG2 type, IgG3 type, or IgG4 type. In Disclosure A or B, the heavy-chain constant region may be a human heavy-chain constant region, but is not limited thereto. Several allotypes are known to exist for human IgG. Specifically, it has been reported that there are some differences in the amino acid sequence of the human IgG constant region among individuals (*Methods Mol. Biol.* 882:635-80 (2012); Sequences of proteins of immunological interest, NIH Publication No. 91-3242). Examples include human IgG1 constant region (SEQ ID NO:18), human IgG2 constant region (SEQ ID NO:19), human IgG3 constant region (SEQ ID NO:20), and human IgG4 constant region (SEQ ID NO:21).

Of these, for example, allotypes called G1m1,17 and G1m3 are known for human IgG1. The allotypes differ in their amino acid sequences: G1m1,17 has aspartic acid at position 356 and leucine at position 358 according to EU numbering, while G1m3 has glutamic acid at position 356 and methionine at position 358 according to EU numbering. There is, however, no report suggesting the presence of significant differences in essential antibody functions and properties among the reported allotypes. Thus, those of ordinary skill in the art can readily predict that various assessments were performed using specific allotypes, and the results are not limited to the allotypes used to obtain the Examples and the same effects are expected with any allotypes. Within the scope of Disclosures A and B described herein, when noted as "human IgG1", "human IgG2, "human IgG3", or "human IgG4", the allotypes are not limited to specific allotypes and can include all reported allotypes.

In an alternative or further embodiment of Disclosure A or B, the light-chain constant region of an antibody can include any constant region of the κ chain (IgK) type or λ chain (IgL1, IgL2, IgL3, IgL6, or IgL7) type. A light-chain constant region may be preferably a human light-chain constant region, but is not limited thereto. There are reports, such as in Sequences of proteins of immunological interest, NIH Publication No. 91-3242, on several allotype sequences that result from gene polymorphism for the human κ chain constant region and human λ chain constant region. Such allotypes include, for example, human κ chain constant region (SEQ ID NO:22) and human λ chain constant region (SEQ ID NO:23). There is, however, no report suggesting the presence of significant differences in essential antibody functions and properties among the reported allotypes. Thus, those of ordinary skill in the art can readily understand that when reference is made to specific allotypes within the scope of Disclosures A and B described herein, the same effects are expected with any allotypes (hereinafter, also collectively referred to as native (human) IgG (type) constant region).

Moreover, since the Fc region of a native IgG antibody constitutes a part of the constant region of the native IgG antibody, when antibodies of Disclosure A or B are, for example, IgG type antibodies or molecules derived therefrom, the antibodies may have an Fc region contained in the constant region of a native IgG (IgG1, IgG2, IgG3, or IgG4 type) (hereinafter, also collectively referred to as a native (human) IgG (type) Fc region). The Fc region of a native IgG can refer to an Fc region consisting of the same amino acid sequence as an Fc region originating from a naturally occurring IgG. Specific examples of the Fc region of a native human IgG can include the Fc regions contained in the human IgG1 constant region (SEQ ID NO:18), human IgG2 constant region (SEQ ID NO:19), human IgG3 constant region (SEQ ID NO:20), or human IgG4 constant region (SEQ ID NO:21) described above (an Fc region of the IgG class can refer to, for example, from cysteine of position 226 according to EU numbering to the C terminus, or from proline of position 230 according to EU numbering to the C terminus.).

In one embodiment, antibodies of Disclosures A and B may include variants in which one or more modifications selected from amino acid substitution, addition, deletion, or insertion have been made to the constant region of a native (preferably human) IgG (the heavy-chain constant region and/or the light-chain constant region) or in the Fc region of a native (preferably human) IgG.

Within the scope of Disclosure A described herein, WO2013/081143 reports that for example, ion concentration-dependent antibodies capable of forming multivalent immune complexes with a multimeric antigen (multivalent antigen-antibody complexes) and multispecific ion concentration-dependent antibodies or multiparatopic ion concentration-dependent antibodies that can form multivalent immune complexes (multivalent antigen-antibody complexes) by recognizing two or more epitopes on monomeric antigens can bind more strongly to FcγR, FcRn, complement receptor, due to the avidity (sum of the strength of binding between multiple epitopes and multiple paratopes) via at least two or more multivalent constant regions (that may be modified) or Fc regions (that may be modified) contained in the antibody molecules, and as a result the antibodies are more rapidly taken up into cells. Thus, when modified to have an increased pI via modification of at least one amino acid residue that can be exposed on the antibody surface, the ion concentration-dependent antibodies described above, which are capable of forming multivalent immune complexes with a multimeric antigen or monomeric antigens, can also be used as antibodies of Disclosure A (ion concentration-dependent antibodies with increased pI). Those of ordinary skill in the art will appreciate that the ion concentration-dependent antibodies with increased pI that can form multivalent immune complexes with a multimeric antigen or monomeric antigens can be more rapidly taken up into cells, as compared to ion concentration-dependent antibodies with increased pI that are incapable of forming multivalent immune complexes. Those of ordinary skill in the art can also understand that in one embodiment, the activity of antibodies of Disclosure A to bind to FcRn and/or FcγR may be increased under a neutral pH condition and in this case, the ion concentration-dependent antibodies with increased pI that can form multivalent immune complexes with a multimeric antigen or monomeric antigens may be even more rapidly taken up into cells.

In one embodiment, antibodies of Disclosure A may be one-armed antibodies (including all embodiments of the one-armed antibodies described in WO2005/063816). Typically, one-armed antibodies are antibodies that lack one of the two Fab regions an ordinary IgG antibody has, and can be produced, without limitations, for example, by the methods described in WO2005/063816. Without limitations, in an IgG-type antibody that has a heavy chain whose structure is, for example, VH-CH1-Hinge-CH2-CH3, when one of the Fab regions is cleaved at a site more to the N terminus than the Hinge (for example, VH or CH1), the antibody will be expressed in a form containing an extra sequence, and when one of the Fab regions is cleaved at a site more to the C terminus than the Hinge (for example, CH2), the Fc region will have an incomplete form. Thus, without limitations, it is preferable from the viewpoint of antibody molecule stability that one-armed antibodies are produced by cleavage in the hinge region (Hinge) of one of the two Fab regions of an IgG antibody. It is more preferable that the heavy chain after cleavage is linked to the uncleaved heavy chain via intramolecular disulfide bond. WO2005/063816 has reported that such one-armed antibodies have an increased stability as compared to Fab molecules. Antibodies with an increased or decreased pI can also be generated by preparing such one-armed antibodies. Furthermore, when an ion concentration-dependent antigen-binding domain is introduced into antibodies with an increased pI that are one-armed antibodies, the antibody half-life in plasma can be further shortened, cellular uptake of the antibody can be further enhanced, antigen elimination from plasma can be further enhanced, or the antibody's affinity for the extracellular matrix can be further increased, as compared to antibodies with increased pI that do not have an ion concentration-dependent antigen-binding domain.

Without being bound by a particular theory, an embodiment where the cellular uptake-accelerating effect of one-armed antibodies is expected can be envisaged to be, but is not limited to, a case in which the pI of a soluble antigen is lower than that of the antibodies. The net pI of a complex consisting of antibodies and antigens can be calculated by known methods by considering that the complex is a single molecule. In this case, the lower the pI of the soluble antigen is, the lower the net pI of the complex is; and the greater the pI of the soluble antigen is, the greater the net pI of the complex is. When an ordinary-type IgG antibody molecule (having two Fabs) is bound to a single low-pI soluble antigen versus to two low-pI soluble antigens, the net pI of the complex is lower in the latter case. When such an ordinary-type antibody is converted into a one-armed antibody, only one antigen can bind to a single molecule of the antibody; reduction of the pI of the complex resulting from the binding of the second antigen can thereby be suppressed. In other words, it is believed that when the pI of the soluble antigen is lower than that of the antibody, the conversion into a one-armed antibody allows the pI of the complex to increase as compared to an ordinary antibody, and thereby accelerates uptake into cells.

Furthermore, without limitations, when the Fab of an ordinary IgG-type antibody molecule (having two Fabs) has a lower pI than that of the Fc, conversion into a one-armed antibody increases the net pI of the complex consisting of the one-armed antibody and antigen. Moreover, when such conversion into a one-armed antibody is performed, it is preferable from the viewpoint of the stability of the one-armed antibody that one of the Fabs is cleaved in the Hinge region located at the junction between Fab and Fc. In this case, the pI can be expected to be effectively increased by selecting a site which would increase the pI of the one-armed antibody to the desired extent.

Thus, those of ordinary skill in the art can understand that without exclusively (or substantially) depending on the antibody amino acid sequence itself and the type of the soluble antigen, the pI of an antibody can be increased and the accompanying cellular uptake of the antigen may be accelerated by converting the antibody into a one-armed antibody by calculating the theoretical pI of the antibody (theoretical pI of Fc and theoretical pI of Fab) and the theoretical pI of the soluble antigen and predicting the relationship on the difference of their theoretical pI values.

In one embodiment, antibodies of Disclosure A or B may be multispecific antibodies, and the multispecific antibody may be, but is not limited to, a bispecific antibody. The multispecific antibody may be a multispecific antibody that contains a first polypeptide and a second polypeptide. Here, "a multispecific antibody that contains a first polypeptide and a second polypeptide" refers to an antibody that binds to at least two or more types of different antigens or at least two or more types of epitopes in a same antigen. The first polypeptide and second polypeptide preferably may contain a heavy-chain variable region, and more preferably the variable region contains CDR(s) and/or FR(s). In another embodiment, the first polypeptide and second polypeptide may preferably each contain a heavy-chain constant region. In still another embodiment, the multispecific antibody may contain a third polypeptide and a fourth polypeptide, each containing a light-chain variable region and preferably also a light-chain constant region. In this case, the first to the fourth polypeptides may assemble together to form a multispecific antibody.

In one embodiment, where antibodies of Disclosure A are multispecific antibodies and the multispecific antibodies contain a heavy-chain constant region, to reduce their pI, for example, the following sequences may be used: IgG2 or IgG4 sequence at position 137; IgG1, IgG2, or IgG4 sequence at position 196; IgG2 or IgG4 sequence at position 203; IgG2 sequence at position 214; IgG1, IgG3, or IgG4 sequence at position 217; IgG1, IgG3, or IgG4 sequence at position 233; IgG4 sequence at position 268; IgG2, IgG3, or IgG4 sequence at position 274; IgG1, IgG2, or IgG4 sequence at position 276; IgG4 sequence at position 355; IgG3 sequence at position 392; IgG4 sequence at position 419; or IgG1, IgG2, or IgG4 sequence at position 435. Meanwhile, to increase their pI, for example, the following sequences may be used: IgG1 or IgG3 sequence at position 137; IgG3 sequence at position 196; IgG1 or IgG3 sequence at position 203; IgG1, IgG3, or IgG4 sequence at position 214; IgG2 sequence at position 217; IgG2 sequence at position 233; IgG1, IgG2, or IgG3 sequence at position 268; IgG1 sequence at position 274; IgG3 sequence at position 276; IgG1, IgG2, or IgG3 sequence at position 355; IgG1, IgG2, or IgG4 sequence at position 392; IgG1, IgG2, or IgG3 sequence at position 419; or IgG3 sequence at position 435.

In one embodiment, where antibodies of Disclosure A have two heavy-chain constant regions, the pIs of the two heavy chain constant regions may be the same or different from each other. Such heavy-chain constant regions may be IgG1, IgG2, IgG3 and IgG4 heavy-chain constant regions which originally have different pIs. Alternatively, it is possible to introduce a pI difference between the two heavy-chain constant regions. Modification sites of at least one amino acid residue for introducing such a pI difference in the constant region may be the position(s) described above or position(s) selected, for example, from the group consisting of position 137, position 196, position 203, position 214, position 217, position 233, position 268, position 274, position 276, position 297, position 355, position 392, position 419, and position 435, according to EU numbering in the heavy-chain constant region as described in WO2009/041643. Alternatively, the amino acid residue of position 297 which is a glycosylation site may be modified to remove the sugar chain, since the removal of a sugar chain from the heavy-chain constant region results in a pI difference.

In one embodiment, antibodies of Disclosure A or B may be polyclonal antibodies or monoclonal antibodies, and mammalian-derived monoclonal antibodies are preferred. Monoclonal antibodies include those produced by hybridomas or those produced by host cells transformed by genetic engineering techniques with expression vectors carrying antibody genes. The antibodies of Disclosure A or B may be, for example, antibodies such as chimeric antibodies, humanized antibodies, or antibodies generated by affinity maturation, or molecules derived therefrom.

In one embodiment, antibodies of Disclosure A or B may be derived, without limitations, from any animal species (for example, human; or nonhuman animals such as mouse, rat, hamster, rabbit, monkey, cynomolgus monkey, Rhesus monkey, hamadryas baboon, chimpanzee, goat, sheep, dog, bovine, or camel), or any birds; and the antibodies are preferably derived from human, monkey, or mouse.

In one embodiment, antibodies of Disclosure A or B may be Ig-type antibodies, and may be preferably IgG-type antibodies.

Within the scope of Disclosures A and B described herein, the Fc receptor (also referred to as "FcR") refers to a receptor protein that can bind to the Fc region of an immunoglobulin (antibody) or a molecule derived therefrom, or an Fc region variant. For example, Fc receptors for IgG, IgA, IgE, and IgM are known as FcγR, FcαR, FcεR, and FcμR, respectively, within the scope of Disclosure A described herein. Fc receptors may also be, for example, FcRn (also referred to as "neonatal Fc receptor"), within the scope of Disclosures A and B described herein.

Within the scope of Disclosure A described herein, "FcγR" may refer to a receptor protein that can bind to the Fc region of an IgG1, IgG2, IgG3, or IgG4 antibody or a molecule derived therefrom, or an Fc region variant, and may include any one or more of, or all members of the family of proteins substantially encoded by the FcγR gene. In human, the family includes, but is not limited to, FcγRI (CD64) including isoforms FcγRIa, FcγRIb, and FcγRIc; FcγRII (CD32) including isoforms FcγRIIa (including allotypes H131 (type H) and R131 (type R)), FcγRIIb (including FcγRIIb-1 and FcγRIIb-2), and FcγRIIc; and FcγRIII (CD16) including isoforms FcγRIIIa (including allotypes V158 and F158) and FcγRIIIb (including allotypes FcγRIIIb-NA1 and FcγRIIIb-NA2), as well as all unidentified human FcγRs and FcγR isoforms and allotypes. Furthermore, FcγRIIb1 and FcγRIIb2 have been reported as splicing variants of human FcγRIIb (hFcγRIIb). There is also a report on a splicing variant called FcγRIIb3 (Brooks et al., *J. Exp. Med,* 170: 1369-1385 (1989)). In addition to those described above, hFcγRIIb includes all splicing variants such as those registered in NCBI under NP_001002273.1, NP_001002274.1, NP_001002275.1, NP_001177757.1, and NP_003992.3. hFcγRIIb also includes all genetic polymorphisms already reported, for example, FcγRIIb (Li et al., Arthritis Rheum. 48:3242-3252 (2003), Kono et al., *Hum. Mol. Genet.* 14:2881-2892 (2005); Kyogoku et al., *Arthritis Rheum.* 46(5):1242-1254 (2002)), as well as all genetic polymorphisms that will be reported in future.

FcγR may be derived from any organism, and may include those derived from humans, mice, rats, rabbits, or monkeys, without being limited thereto. Mouse FcγRs include, but are not limited to, FcγRI (CD64), FcγRII (CD32), FcγRIII (CD16) and FcγRIII-2 (CD16-2), as well as all unidentified mouse FcγRs, and FcγR isoforms and allotypes. Such preferred FcγR includes, for example, human FcγRI (CD64), FcγRIIA (CD32), FcγRIIB (CD32), FcγRIIIA (CD16), or FcγRIIIB (CD16). Since FcγR is present as a membrane form in vivo, it may be used in experimental systems after being artificially converted into an appropriate soluble form.

For example, as shown in WO2014/163101, the polynucleotide sequence and amino acid sequence of FcγRI may be the sequences shown in NM 000566.3 and NP_000557.1, respectively; the polynucleotide sequence and amino acid sequence of FcγRIIA may be the sequences shown in BC020823.1 and AAH20823.1, respectively; the polynucleotide sequence and amino acid sequence of FcγRIIB may be the sequences shown in BC146678.1 and AAI46679.1, respectively; the polynucleotide sequence and amino acid sequence of FcγRIIIA may be the sequences shown in BC033678.1 and AAH33678.1, respectively; the polynucleotide sequence and amino acid sequence of FcγRIIIB may be the sequences shown in BC128562.1 and AAI28563.1, respectively (RefSeq accession numbers are shown).

FcγRIIa has two genetic polymorphisms, in which the amino acid at position 131 of FcγRIIa is replaced with histidine (type H) or arginine (type R) (*J. Exp. Med.* 172: 19-25, 1990).

In FcγRI (CD64) which includes FcγRIa, FcγRIb, and FcγRIc, and FcγRIII (CD16) which includes FcγRIIIa (including allotypes V158 and F158), the α chain that binds to the Fc region of IgG is associated with a common γ chain having ITAM which transmits activation signals inside cells. FcγRIIIb (including allotypes FcγRIIIb-NA1 and FcγRIIIb-NA2) is a GPI anchor protein. Meanwhile, the cytoplasmic domain of FcγRII (CD32) which includes the FcγRIIa (including allotypes H131 and R131) and FcγRIIc isoforms contains ITAM. These receptors are expressed on many immune cells such as macrophages, mast cells, and antigen-presenting cells. The activation signals transduced upon binding of these receptors to the Fc region of IgG promote the phagocytotic ability of macrophages, production of inflammatory cytokines, degranulation of mast cells, and the increased function of antigen-presenting cells. An FcγR that has the ability to transduce activation signals as described above is also referred to as an activating FcγR within the scope of Disclosures A and B described here.

Meanwhile, the cytoplasmic domain of FcγRIIb (including FcγRIIb-1 and FcγRIIb-2) contains ITIM which transmits inhibitory signals. In B cells, the crosslinking between FcγRIIb and B cell receptor (BCR) suppresses the activation signals from BCR, which results in suppression of antibody production by BCR. In macrophages, the crosslinking of FcγRIII and FcγRIIb suppresses the phagocytic ability and the ability to produce inflammatory cytokines. An FcγR that has the ability to transduce inhibitory signals as described above is also referred to as an inhibitory Fcγreceptor within the scope of Disclosures A and B described herein.

Within the scope of Disclosure A described herein, whether the binding activity of an antibody or Fc region (variant) toward various FcγRs has been increased, (substantially) maintained, or reduced as compared to the antibody or Fc region (variant) before modification can be assessed by methods known to those of ordinary skill in the art. Such methods are not particularly limited and those described in the present Examples may be used, and for example, surface plasmon resonance (SPR) phenomenon-based BIACORE (Proc. Natl. Acad. Sci. USA (2006) 103 (11), 4005-4010) may be used. Alternatively, for example, ELISA and fluorescence activated cell sorting (FACS) as well as ALPHA screen (Amplified Luminescent Proximity Homogeneous Assay) may be used. In these assays, the extracellular domain of human FcγR may be used as a soluble antigen (for example, WO2013/047752).

For the pH condition for measuring the binding activity between an FcγR-binding domain contained in an antibody or Fc region (variant) and FcγR, an acidic or neutral pH condition may suitably be used. For the temperature used in the measurement conditions, the binding activity (binding affinity) between an FcγR-binding domain and FcγR may be assessed, for example, at any temperature between 10° C. to 50° C. A preferred temperature for determining the binding activity (binding affinity) of a human FcγR-binding domain to FcγR is, for example, 15° C. to 40° C. More preferably, to determine the binding activity (binding affinity) between an FcγR-binding domain and FcγR, any temperature from 20° C. to 35° C., for example, such as any one of 20, 21, 22, 23, 24, 25, 26, 27, 28, 29, 30, 31, 32, 33, 34, and 35° C. may be used. A non-limiting example of such temperature is 25° C.

In one embodiment, where an antibody of Disclosure A or B has a constant region (that may be modified), the constant region may have an Fc region or an Fc region variant (preferably, a human Fc region or a human Fc region variant), and preferably has an FcγR-binding domain within the scope of Disclosure A and an FcRn-binding domain within the scope of Disclosures A and B described herein.

In one embodiment, where an antibody of Disclosure A has FcγR-binding activity, it may have an FcγR-binding domain, preferably a human FcγR-binding domain. The FcγR-binding domain is not particularly limited as long as the antibody has binding activity to or affinity for FcγR at acidic pH and/or neutral pH, and it may be a domain that has an activity to directly or indirectly bind FcγR.

In one embodiment, where an antibody of Disclosure A has FcγR-binding activity, it is preferable that the FcγR-binding activity of the antibody under a neutral pH condition is increased as compared to that of a reference antibody which contains a native IgG constant region. From the perspective of comparing the FcγR-binding activity between the two, it is preferable, without limitations, that the antibody of Disclosure A and the reference antibody which contains a native IgG constant region have identical amino acid sequences in regions (for example, the variable region) other than, preferably, the constant region of the antibody of Disclosure A which has been modified at one or more amino acid residues.

In one embodiment, where an antibody of Disclosure A has an FcγR-binding activity or an increased FcγR-binding activity under a neutral pH condition (e.g., pH 7.4), without being bound by a theory, the antibody is thought to possess the following properties in combination: the property of being shuttled between plasma and cellular endosome and repeatedly binding to multiple antigens as a single antibody molecule by having an ion concentration-dependent antigen-binding domain; the property of being rapidly taken up into cells by having an increased pI and increased positive charge in the overall antibody; and the property of being rapidly taken up into cells by having an increased FcγR-binding activity under a neutral pH condition. As a result, the antibody half-life in plasma can be further shortened, or the binding activity of the antibody toward the extracellular matrix can be further increased, or antigen elimination from plasma can be further promoted; thus the antibody of Disclosure A is beneficial. Those of ordinary skill in the art can routinely determine an optimal pI value for the antibody to take advantage of these properties.

In one embodiment, an FcγR-binding domain whose FcγR-binding activity is higher than that of the Fc region or constant region of a native human IgG in which the sugar chain linked at position 297 according to EU numbering is a fucose-containing sugar chain can be produced by modifying amino acid residues in the Fc region or constant region of a native human IgG (see WO2013/047752). Furthermore, a domain of any structure that binds to FcγR can be used as an FcγR-binding domain. In this case, the FcγR-binding domain can be produced without the need to introduce an amino acid modification, and alternatively, its affinity for FcγR may be increased by introducing an additional modification. Such FcγR-binding domains can include Fab fragment antibodies that bind to FcγRIIIa, camel-derived single domain antibodies, and single chain Fv antibodies described in Schlapschly et al. (*Protein Eng. Des. Sel.* 22 (3):175-188 (2009), Behar et al. (*Protein Eng. Des. Sel.* 21(1):1-10 (2008)), and Kipriyanov et al., *J Immunol.* 169(1):137-144 (2002), and the FcγRI-binding cyclic peptide described in Bonetto et al., *FASEB J* 23(2):575-585 (2008). Whether the FcγR-binding activity of an FcγR-binding domain is higher than that of the Fc region or constant region of a native human IgG in which the sugar chain linked at position 297 according to EU numbering is a fucose-containing sugar chain can be appropriately assessed using the methods described above.

In one embodiment of Disclosure A, the starting FcγR-binding domain preferably includes, for example, (human) IgG Fc region or (human) IgG constant region. As long as a variant of the starting Fc region or the starting constant region can bind to human FcγR in a neutral pH range, any Fc region or constant region can be used as the starting Fc region or starting constant region. An Fc region or constant region obtained by further modifying a starting Fc region or starting constant region whose amino acid residue(s) has been already modified from an Fc region or constant region can also be appropriately used as the Fc region or constant region of Disclosure A. A starting Fc region or starting constant region may refer to the polypeptide itself, a composition containing the starting Fc region or starting constant region, or an amino acid sequence encoding the starting Fc region or starting constant region. The starting Fc region or starting constant region may include known Fc regions or known constant regions produced by recombination technologies. The origin of the starting Fc region or starting constant region is not limited, and it can be obtained from any organism of nonhuman animals or from a human. Furthermore, the starting FcγR-binding domain can be obtained from cynomolgus monkeys, marmosets, Rhesus monkeys, chimpanzees, or humans. The starting Fc region or starting constant region can be preferably obtained from human IgG1; however, it is not limited to a particular IgG class. This means that the Fc region of human IgG1, IgG2, IgG3, or IgG4 can be used as an appropriate starting FcγR-binding domain, and it also means that within the scope of Disclosure A described herein, an Fc region or constant region of an IgG class or subclass derived from any organism can be preferably used as the starting Fc region or starting constant region. Examples of a native IgG variant or modified form are described in publicly known literature such as Strohl, *Curr. Opin. Biotechnol.* 20(6):685-691 (2009); Presta, *Curr. Opin. Immunol.* 20(4):460-470 (2008); Davis et al., *Protein Eng. Des. Sel.* 23(4):195-202 (2010); WO2009/086320, WO2008/092117; WO2007/041635; and WO2006/105338, but not limited thereto.

In one embodiment, amino acid residues of the starting FcγR-binding domain, starting Fc region, or starting constant region may contain, for example, one or more mutations: for example, substitutions with amino acid residues that are different from those in the starting Fc region or starting constant region; insertions of one or more amino acid residues into the amino acid residues in the starting Fc region or starting constant region; or deletions of one or more amino acid residues from those of the starting Fc region or starting constant region. The amino acid sequences of Fc regions or constant regions after modifications are preferably amino acid sequences containing at least a portion of an Fc region or constant region that may not occur naturally. Such variants necessarily have a sequence identity or similarity of less than 100% to the starting Fc regions or starting constant regions. For example, the variants have an amino acid sequence identity or similarity of about 75% to less than 100%, more preferably about 80% to less than 100%, even more preferably about 85% to less than 100%, still more preferably about 90% to less than 100%, and yet more preferably about 95% to less than 100% to the amino acid sequence of the starting Fc region or starting constant region. In a non-limiting example, at least one amino acid is different between a modified Fc region or constant region of Disclosure A and the starting Fc region or starting constant region.

In one embodiment, an Fc region or constant region that has FcγR-binding activity in an acidic pH range and/or in a neutral pH range, which may be contained in an antibody of Disclosure A, may be obtained by any method. Specifically, a variant of Fc region or constant region that has FcγR-binding activity in a neutral pH range may be obtained by modifying amino acids of a human IgG antibody which can be used as the starting Fc region or starting constant region. IgG antibody Fc regions or IgG antibody constant regions suitable for modification can include, for example, the Fc regions or constant regions of human IgG (IgG1, IgG2, IgG3, or IgG4, or variants thereof), and mutants spontaneously generated therefrom. For the Fc regions or constant regions of human IgG1, human IgG2, human IgG3, or human IgG4 antibodies, a number of allotype sequences due to genetic polymorphism are described in "Sequences of proteins of immunological interest", NIH Publication No. 91-3242, and any of them may be used in Disclosure A. In particular, for the human IgG1 sequence, the amino acid sequence of positions 356 to 358 according to EU numbering may be DEL or EEM.

In a further embodiment within the scope of Disclosure A, the modification into other amino acids is not limited as long as the variants have an FcγR-binding activity in a neutral pH range. Amino acid position(s) of such modification are reported, for example, in: WO2007/024249, WO2007/021841, WO2006/031370, WO2000/042072, WO2004/029207, WO2004/099249, WO2006/105338, WO2007/041635, WO2008/092117, WO2005/070963, WO2006/020114, WO2006/116260, WO2006/023403, WO2013/047752, WO2006/019447, WO2012/115241, WO2013/125667, WO2014/030728, WO2014/163101, WO2013/118858, and WO2014/030750.

Sites of amino acid modification in the constant region or Fc region to increase the FcγR-binding activity in a neutral pH range can include, for example, one or more positions selected from the group consisting of position: 221, 222, 223, 224, 225, 227, 228, 230, 231, 232, 233, 234, 235, 236, 237, 238, 239, 240, 241, 243, 244, 245, 246, 247, 249, 250, 251, 254, 255, 256, 258, 260, 262, 263, 264, 265, 266, 267, 268, 269, 270, 271, 272, 273, 274, 275, 276, 278, 279, 280, 281, 282, 283, 284, 285, 286, 288, 290, 291, 292, 293, 294, 295, 296, 297, 298, 299, 300, 301, 302, 303, 304, 305, 311, 313, 315, 317, 318, 320, 322, 323, 324, 325, 326, 327, 328, 329, 330, 331, 332, 333, 334, 335, 336, 337, 339, 376, 377, 378, 379, 380, 382, 385, 392, 396, 421, 427, 428, 429, 434, 436, and 440, according to EU numbering in the Fc region or constant region of a human IgG antibody, as described in WO2013/047752. Modification of such amino acid residue may increase the FcγR binding of the Fc region or constant region of an IgG antibody under a neutral pH condition. WO2013/047752 describes, as preferred modifications in an IgG-type constant region or Fc region, for example, modification of one or more amino acid residues selected from the group consisting of: the amino acid at position 221 to either Lys or Tyr; the amino acid at position 222 to any one of Phe, Trp, Glu, and Tyr; the amino acid at position 223 to any one of Phe, Trp, Glu, and Lys; the amino acid at position 224 to any one of Phe, Trp, Glu, and Tyr; the amino acid at position 225 to any one of Glu, Lys, and Trp; the amino acid at position 227 to any one of Glu, Gly, Lys, and Tyr; the amino acid at position 228 to any one of Glu, Gly, Lys, and Tyr; the amino acid at position 230 to any one of Ala, Glu, Gly, and Tyr; the amino acid at position 231 to any one of Glu, Gly, Lys, Pro, and Tyr; the amino acid at position 232 to any one of Glu, Gly, Lys, and Tyr; the amino acid at position 233 to any one of Ala, Asp, Phe, Gly, His, Ile, Lys, Leu, Met, Asn, Gln, Arg, Ser, Thr, Val, Trp, and Tyr; the amino acid at position 234 to any one of Ala, Asp, Glu, Phe, Gly, His, Ile, Lys, Met, Asn, Pro, Gln, Arg, Ser, Thr, Val, Trp, and Tyr; the amino acid at position 235 to any one of Ala, Asp, Glu, Phe, Gly, His, Ile, Lys, Met, Asn, Pro, Gln, Arg, Ser, Thr, Val, Trp, and Tyr; the amino acid at position 236 to any one of Ala, Asp, Glu, Phe, His, Ile, Lys, Leu, Met, Asn, Pro, Gln, Arg, Ser, Thr, Val, Trp, and Tyr; the amino acid at position 237 to any one of Asp, Glu, Phe, His, Ile, Lys, Leu, Met, Asn, Pro, Gln, Arg, Ser, Thr, Val, Trp, and Tyr; the amino acid at position 238 to any one of Asp, Glu, Phe, Gly, His, Ile, Lys, Leu, Met, Asn, Gln, Arg, Ser, Thr, Val, Trp, and Tyr; the amino acid at position 239 to any one of Asp, Glu, Phe, Gly, His, Ile, Lys, Leu, Met, Asn, Pro, Gln, Arg, Thr, Val, Trp, and Tyr; the amino acid at position 240 to any one of Ala, Ile, Met, and Thr; the amino acid at position 241 to any one of Asp, Glu, Leu, Arg, Trp, and Tyr; the amino acid at position 243 to any one of Glu, Leu, Gln, Arg, Trp, and Tyr; the amino acid at position 244 to His; the amino acid at position 245 to Ala; the amino acid at position 246 to any one of Asp, Glu, His, and Tyr; the amino acid at position 247 to any one of Ala, Phe, Gly, His, Ile, Leu, Met, Thr, Val, and Tyr; the amino acid at position 249 to any one of Glu, His, Gln, and Tyr; the amino acid at position 250 to either Glu or Gln; the amino acid at position 251 to Phe; the amino acid at position 254 to any one of Phe, Met, and Tyr; the amino acid at position 255 to any one of Glu, Leu, and Tyr; the amino acid at position 256 to any one of Ala, Met, and Pro; the amino acid at position 258 to any one of Asp, Glu, His, Ser, and Tyr; the amino acid at position 260 to any one of Asp, Glu, His, and Tyr; the amino acid at position 262 to any one of Ala, Glu, Phe, Ile, and Thr; the amino acid at position 263 to any one of Ala, Ile, Met, and Thr; the amino acid at position 264 to any one of Asp, Glu, Phe, Gly, His, Ile, Lys, Leu, Met, Asn, Pro, Gln, Arg, Ser, Thr, Trp, and Tyr; the amino acid at position 265 to any one of Ala, Leu, Phe, Gly, His, Ile, Lys, Leu, Met, Asn, Pro, Gln, Arg, Ser, Thr, Val, Trp, and Tyr; the amino acid at position 266 to any one of Ala, Ile, Met, and Thr; the amino acid at position 267 to any one of Asp, Glu, Phe, His, Ile, Lys, Leu, Met, Asn, Pro, Gln, Arg, Thr, Val, Trp, and Tyr; the amino acid at position 268 to any one of Asp, Glu, Phe, Gly, Ile, Lys, Leu, Met, Pro, Gln, Arg, Thr, Val, and Trp; the amino acid at position 269 to any one of Phe, Gly, His, Ile, Lys, Leu, Met, Asn, Pro, Arg, Ser, Thr, Val, Trp, and Tyr; the amino acid at position 270 to any one of Glu, Phe, Gly, His, Ile, Leu, Met, Pro, Gln, Arg, Ser, Thr, Trp, and Tyr; the amino acid at position 271 to any one of Ala, Asp, Glu, Phe, Gly, His, Ile, Lys, Leu, Met, Asn, Gln, Arg, Ser, Thr, Val, Trp, and Tyr; the amino acid at position 272 to any one of Asp, Phe, Gly, His, Ile, Lys, Leu, Met, Pro, Arg, Ser, Thr, Val, Trp, and Tyr; the amino acid at position 273 to either Phe or Ile; the amino acid at position 274 to any one of Asp, Glu, Phe, Gly, His, Ile, Leu, Met, Asn, Pro, Arg, Ser, Thr, Val, Trp, and Tyr; the amino acid at position 275 to either Leu or Trp; the amino acid at position 276 to any one of Asp, Glu, Phe, Gly, His, Ile, Leu, Met, Pro, Arg, Ser, Thr, Val, Trp, and Tyr; the amino acid at position 278 to any one of Asp, Glu, Gly, His, Ile, Lys, Leu, Met, Asn, Pro, Gln, Arg, Ser, Thr, Val, and Trp; the amino acid at position 279 to Ala; the amino acid at position 280 to any one of Ala, Gly, His, Lys, Leu, Pro, Gln, Trp, and Tyr; the amino acid at position 281 to any one of Asp, Lys, Pro, and Tyr; the amino acid at position 282 to any one of Glu, Gly, Lys, Pro, and Tyr; the amino acid at position 283 to any one of Ala, Gly, His, Ile, Lys, Leu, Met, Pro, Arg, and Tyr; the amino acid at position 284 to any one of Asp, Glu, Leu, Asn, Thr, and Tyr; the amino acid at position 285 to any one of Asp, Glu, Lys, Gln, Trp, and Tyr; the amino acid at position 286 to any one of Glu, Gly, Pro, and Tyr; the amino acid at position 288 to any one of Asn, Asp, Glu, and Tyr; the amino acid at position 290 to any one of Asp, Gly, His, Leu, Asn, Ser, Thr, Trp, and Tyr; the amino acid at position 291 to any one of Asp, Glu, Gly, His, Ile, Gln, and Thr; the amino acid at position 292 to any one of Ala, Asp, Glu, Pro, Thr, and Tyr; the amino acid at position 293 to any one of Phe, Gly, His, Ile, Leu, Met, Asn, Pro, Arg, Ser, Thr, Val, Trp, and Tyr; the amino acid at position 294 to any one of Phe, Gly, His, Ile, Lys, Leu, Met, Asn, Pro, Arg, Ser, Thr, Val, Trp, and Tyr; the amino acid at position 295 to any one of Asp, Glu, Phe, Gly, His, Ile, Lys, Met, Asn, Pro, Arg, Ser, Val, Trp, and Tyr; the amino acid at position 296 to any one of Ala, Asp, Glu, Gly, His, Ile, Lys, Leu, Met, Asn, Gln, Arg, Ser, Thr, and Val; the amino acid at position 297 to any one of Asp, Glu, Phe, Gly, His, Ile, Lys, Leu, Met, Pro, Gln, Arg, Ser, Thr, Val, Trp, and Tyr; the amino acid at position 298 to any one of Ala, Asp, Glu, Phe, His, Ile, Lys, Met, Asn, Gln, Arg, Thr, Val, Trp, and Tyr; the amino acid at position 299 to any one of Ala, Asp, Glu, Phe, Gly, His, Ile, Lys, Leu, Met, Asn, Pro, Gln, Arg, Ser, Val, Trp, and Tyr; the amino acid at position 300 to any one of Ala, Asp, Glu, Gly, His, Ile, Lys, Leu, Met, Asn, Pro, Gln, Arg, Ser, Thr, Val, and Trp; the amino acid at position 301 to any one of Asp, Glu, His, and Tyr; the amino acid at position 302 to Ile; the amino acid at position 303 to any one of Asp, Gly, and Tyr; the amino acid at position 304 to any one of Asp, His, Leu, Asn, and Thr; the amino acid at position 305 to any one of Glu, Ile, Thr, and Tyr; the amino acid at position 311 to any one of Ala, Asp, Asn, Thr, Val, and Tyr; the amino acid at position 313 to Phe; the amino acid at position 315 to Leu; the amino acid at position 317 to either Glu or Gln; the amino acid at position 318 to any one of His, Leu, Asn, Pro, Gln, Arg, Thr, Val, and Tyr; the amino acid at position 320 to any one of Asp, Phe, Gly, His, Ile, Leu, Asn, Pro, Ser, Thr, Val, Trp, and Tyr; the amino acid at position 322 to any one of Ala, Asp, Phe, Gly, His, Ile, Pro, Ser, Thr, Val, Trp, and Tyr; the amino acid at position 323 to Ile; the amino acid at position 324 to any one of Asp, Phe, Gly, His, Ile, Leu, Met, Pro, Arg, Thr, Val, Trp, and Tyr; the amino acid at position 325 to any one of Ala, Asp, Glu, Phe, Gly, His, Ile, Lys, Leu, Met, Pro, Gln, Arg, Ser, Thr, Val, Trp, and Tyr; the amino acid at position 326 to any one of Ala, Asp, Glu, Gly, Ile, Leu, Met, Asn, Pro, Gln, Ser, Thr, Val, Trp, and Tyr; the amino acid at position 327 to any one of Ala, Asp, Glu, Phe, Gly, His, Ile, Lys, Leu, Met, Asn, Pro, Arg, Thr, Val, Trp, and Tyr; the amino acid at position 328 to any one of Ala, Asp, Glu, Phe, Gly, His, Ile, Lys, Met, Asn, Pro, Gln, Arg, Ser, Thr, Val, Trp, and Tyr; the amino acid at position 329 to any one of Asp, Glu, Phe, Gly, His, Ile, Lys, Leu, Met, Asn, Gln, Arg, Ser, Thr, Val, Trp, and Tyr; the amino acid at position 330 to any one of Cys, Glu, Phe, Gly, His, Ile, Lys, Leu, Met, Asn, Pro, Arg, Ser, Thr, Val, Trp, and Tyr; the amino acid at position 331 to any one of Asp, Phe, His, Ile, Leu, Met, Gln, Arg, Thr, Val, Trp, and Tyr; the amino acid at position 332 to any one of Ala, Asp, Glu, Phe, Gly, His, Lys, Leu, Met, Asn, Pro, Gln, Arg, Ser, Thr, Val, Trp, and Tyr; the amino acid at position 333 to any one of Ala, Asp, Glu, Phe, Gly, His, Ile, Leu, Met, Pro, Ser, Thr, Val, and Tyr; the amino acid at position 334 to any one of Ala, Glu, Phe, Ile, Leu, Pro, and Thr; the amino acid at position 335 to any one of Asp, Phe, Gly, His, Ile, Leu, Met, Asn, Pro, Arg, Ser, Val, Trp, and Tyr; the amino acid at position 336 to any one of Glu, Lys, and Tyr; the amino acid at position 337 to any one of Glu, His, and Asn; the amino acid at position 339 to any one of Asp, Phe, Gly, Ile, Lys, Met, Asn, Gln, Arg, Ser, and Thr; the amino acid at position 376 to either Ala or Val; the amino acid at position 377 to either Gly or Lys; the amino acid at position 378 to Asp; the amino acid at position 379 to Asn; the amino acid at position 380 to any one of Ala, Asn, and Ser; the amino acid at position 382 to either Ala or Ile; the amino acid at position 385 to Glu; the amino acid at position 392 to Thr; the amino acid at position 396 to Leu; the amino acid at position 421 to Lys; the amino acid at position 427 to Asn; the amino acid at position 428 to either Phe or Leu; the amino acid at position 429 to Met; the amino acid at position 434 to Trp; the amino acid at position 436 to Ile; and the amino acid at position 440 to any one of Gly, His, Ile, Leu, and Tyr, according to EU numbering. The number of amino acids to be modified is not particularly limited, and it is possible to modify an amino acid at only one position or amino acids at two or more positions. Combinations of amino acid modifications at two or more positions are shown in Table 5 of WO2013/047752. Modification of these amino acid residues can also be appropriately introduced into the antibodies of Disclosure A.

In one embodiment, the binding activity of (the FcγR-binding domain of) the antibody of Disclosure A toward (human) FcγR(s), such as any one or more of FcγRI, FcγRIIa, FcγRIIb, FcγRIIIa, and FcγRIIIb, may be higher than that of (the Fc region or constant region of) a native IgG or that of a reference antibody containing the starting Fc region or starting constant region. For example, the FcγR-binding activity of (the FcγR-binding domain of) an antibody of Disclosure A may be 55% or more, 60% or more, 65% or more, 70% or more, 75% or more, 80% or more, 85% or more, 90% or more, 95% or more, 100% or more, 105% or more, preferably 110% or more, 115% or more, 120% or more, 125% or more, particularly preferably 130% or more, 135% or more, 140% or more, 145% or more, 150% or more, 155% or more, 160% or more, 165% or more, 170% or more, 175% or more, 180% or more, 185% or more, 190% or more, or 195% or more as compared to the FcγR-binding activity of the reference antibody, or 2-fold or more, 2.5-fold or more, 3-fold or more, 3.5-fold or more, 4-fold or more, 4.5-fold or more, 5-fold or more, 7.5-fold or more, 10-fold or more, 20-fold or more, 30-fold or more, 40-fold or more, 50-fold or more, 60-fold or more, 70-fold or more, 80-fold or more, 90-fold or more, or 100-fold or more greater than the FcγR-binding activity of the reference antibody.

In a further embodiment, the level of increase in the binding activity to an inhibitory FcγR (FcγRIIb-1 and/or FcγRIIb-2) (in a neutral pH range) may be greater than the level of increase in the binding activity to an activating FcγR (FcγRIa: FcγRIb; FcγRIc; FcγRIIIa including allotype V158; FcγRIIIa including allotype F158; FcγRIIIb including allotype FcγRIIIb-NA1; FcγRIIIb including allotype FcγRIIIb-NA2; FcγRIIa including allotype H131; or FcγRIIa including allotype R131).

In one embodiment, an antibody of Disclosure A may have binding activity to FcγRIIb (including FcγRIIb-1 and FcγRIIb-2).

In one embodiment, preferred FcγR-binding domains of Disclosure A also include, for example, FcγR-binding domains whose binding activity to a specific FcγR is greater than the binding activity to other FcγR (FcγR-binding domains having a selective FcγR-binding activity). Where an antibody (or the Fc region as the FcγR-binding domain) is used, a single antibody molecule can bind only to a single FcγR molecule. Thus, a single antibody molecule in a state bound to an inhibitory FcγR cannot bind to other activating FcγRs, and a single antibody molecule in a state bound to an activating FcγR cannot bind to other activating FcγRs or inhibitory FcγRs.

As described above, an activating FcγR preferably includes, for example, FcγRI (CD64) such as FcγRIa, FcγRIb, or FcγRIc; and FcγRIII (CD16) such as FcγRIIIa (such as allotype V158 or F158) or FcγRIIIb (such as allotype FcγRIIIb-NA1 or FcγRIIIb-NA2). Meanwhile, an inhibitory FcγR preferably includes, for example, FcγRIIb (such as FcγRIIb-1 or FcγRIIb-2).

In one embodiment, FcγR-binding domains that have a greater binding activity to inhibitory FcγR than to activating FcγR can be used as the selective FcγR-binding domain contained in an antibody of Disclosure A. Such selective FcγR-binding domains can include, for example, FcγR-binding domains that have a greater binding activity to FcγRIIb (such as FcγRIIb-1 and/or FcγRIIb-2) than to any one or more of activating FcγR selected from the group consisting of: FcγRI (CD64) such as FcγRIa, FcγRIb, or FcγRIc; FcγRIII (CD16) such as FcγRIIIa (such as allotype V158 or F158) or FcγRIIIb (such as FcγRIIIb-NA1 or FcγRIIIb-NA2); FcγRII (CD32) such as FcγRIIa (including allotype H131 or R131); and FcγRIIc.

Furthermore, whether an FcγR-binding domain has a selective binding activity can be assessed by comparing the binding activity to each FcγR determined by the methods described above, for example, by comparing the value (ratio) obtained by dividing the KD value for activating FcγR by the KD value for inhibitory FcγR, more specifically by comparing the FcγR selectivity index shown in Equation 1 below:

FcγR selectivity index=KD value for activating FcγR/KD value for inhibitory FcγR    [Equation 1]:

In Equation 1, the KD value for activating FcγR refers to the KD value for one or more of: FcγRIa; FcγRIb; FcγRIc; FcγRIIIa including allotype V158 and/or F158; FcγRIIIb including FcγRIIIb-NA1 and/or FcγRIIIb-NA2; FcγRIIa including allotype H131 and/or R131; and FcγRIIc; and the KD value for inhibitory FcγR refers to the KD value for FcγRIIb-1 and/or FcγRIIb-2. The activating FcγR and inhibitory FcγR for use in determining the KD values may be selected in any combination. For example, it is possible to use a value (ratio) determined by dividing the KD value for FcγRIIa including allotype H131 by the KD value for FcγRIIb-1 and/or FcγRIIb-2, without limitations thereto.

The FcγR selectivity index can be, for example: 1.2 or greater, 1.3 or greater, 1.4 or greater, 1.5 or greater, 1.6 or greater, 1.7 or greater, 1.8 or greater, 1.9 or greater, 2 or greater, 3 or greater, 5 or greater, 6 or greater, 7 or greater, 8 or greater, 9 or greater, 10 or greater, 15 or greater, 20 or greater, 25 or greater, 30 or greater, 35 or greater, 40 or greater, 45 or greater, 50 or greater, 55 or greater, 60 or greater, 65 or greater, 70 or greater, 75 or greater, 80 or greater, 85 or greater, 90 or greater, 95 or greater, 100 or greater, 110 or greater, 120 or greater, 130 or greater, 140 or greater, 150 or greater, 160 or greater, 170 or greater, 180 or greater, 190 or greater, 200 or greater, 210 or greater, 220 or greater, 230 or greater, 240 or greater, 250 or greater, 260 or greater, 270 or greater, 280 or greater, 290 or greater, 300 or greater, 310 or greater, 320 or greater, 330 or greater, 340 or greater, 350 or greater, 360 or greater, 370 or greater, 380 or greater, 390 or greater, 400 or greater, 410 or greater, 420 or greater, 430 or greater, 440 or greater, 450 or greater, 460 or greater, 470 or greater, 480 or greater, 490 or greater, 500 or greater, 520 or greater, 540 or greater, 560 or greater, 580 or greater, 600 or greater, 620 or greater, 640 or greater, 660 or greater, 680 or greater, 700 or greater, 720 or greater, 740 or greater, 760 or greater, 780 or greater, 800 or greater, 820 or greater, 840 or greater, 860 or greater, 880 or greater, 900 or greater, 920 or greater, 940 or greater, 960 or greater, 980 or greater, 1000 or greater, 1500 or greater, 2000 or greater, 2500 or greater, 3000 or greater, 3500 or greater, 4000 or greater, 4500 or greater, 5000 or greater, 5500 or greater, 6000 or greater, 6500 or greater, 7000 or greater, 7500 or greater, 8000 or greater, 8500 or greater, 9000 or greater, 9500 or greater, 10000 or greater, or 100000 or greater; but it is not limited thereto.

In one embodiment, (an antibody containing) an Fc region variant or constant region variant in which the amino acid at position 238 or 328, according to EU numbering of human IgG (IgG1, IgG2, IgG3, or IgG4) is Asp or Glu, respectively, can be preferably used as antibodies of Disclosure A containing an Fc region variant or constant region variant, since as specifically described in WO2013/125667, WO2012/115241, and WO2013/047752, it has a greater binding activity to FcγRIIb-1 and/or FcγRIIb-2 than to FcγRIa, FcγRIb, FcγRIc, FcγRIIIa including allotype V158, FcγRIIIa including allotype F158, FcγRIIIb including allotype FcγRIIIb-NA1, FcγRIIIb including allotype FcγRIIIb-NA2, FcγRIIa including allotype H131, FcγRIIa including allotype R131, and/or FcγRIIc. In such an embodiment, the antibodies of Disclosure A have binding activity to all activating FcγRs (herein, which are selected from the group consisting of FcγRIa, FcγRIb, FcγRIc, FcγRIIIa FcγRIIIb FcγRIIa) and FcγRIIb, and their FcγRIIb-binding activity is maintained or increased, and/or their binding activity to all activating FcγRs is reduced, as compared to the reference antibody that contains a native IgG constant region or a native IgG Fc region.

In one embodiment for the antibodies of Disclosure A containing an Fc region variant or constant region variant, their binding activity to FcγRIIb may be maintained or increased and their binding activity to FcγRIIa (type H) and FcγRIIa (type R) may be reduced as compared to those of a reference antibody having the constant region or Fc region of a native IgG. Such antibodies may have increased binding selectivity to FcγRIIb over FcγRIIa.

Within the scope of Disclosure A described herein, the extent that the "binding activity to all activating FcγRs is reduced" can be, but is not limited to, 99% or less, 98% or less, 97% or less, 96% or less, 95% or less, 94% or less, 93% or less, 92% or less, 91% or less, 90% or less, 88% or less, 86% or less, 84% or less, 82% or less, 80% or less, 78% or less, 76% or less, 74% or less, 72% or less, 70% or less, 68% or less, 66% or less, 64% or less, 62% or less, 60% or less, 58% or less, 56% or less, 54% or less, 52% or less, 50% or less, 45% or less, 40% or less, 35% or less, 30% or less, 25% or less, 20% or less, 15% or less, 10% or less, 5% or less, 4% or less, 3% or less, 2% or less, 1% or less, 0.5% or less, 0.4% or less, 0.3% or less, 0.2% or less, 0.1% or less, 0.05% or less, 0.01% or less, or 0.005% or less.

Within the scope of Disclosure A described herein, the extent that the "FcγRIIb-binding activity is maintained or increased", the "binding activity to FcγRIIb is maintained or increased", or the "maintained or increased binding activity to FcγRIIb" can be, but is not limited to, 55% or greater, 60% or greater, 65% or greater, 70% or greater, 75% or greater, 80% or greater, 85% or greater, 87% or greater, 88% or greater, 89% or greater, 90% or greater, 91% or greater, 92% or greater, 93% or greater, 94% or greater, 95% or greater, 96% or greater, 97% or greater, 98% or greater, 99% or greater, 99.5% or greater, 100% or greater, 101% or greater, 102% or greater, 103% or greater, 104% or greater, 105% or greater, 106% or greater, 107% or greater, 108% or greater, 109% or greater, 110% or greater, 112% or greater, 114% or greater, 116% or greater, 118% or greater, 120% or greater, 122% or greater, 124% or greater, 126% or greater, 128% or greater, 130% or greater, 132% or greater, 134% or greater, 136% or greater, 138% or greater, 140% or greater, 142% or greater, 144% or greater, 146% or greater, 148% or greater, 150% or greater, 155% or greater, 160% or greater, 165% or greater, 170% or greater, 175% or greater, 180% or greater, 185% or greater, 190% or greater, 195% or greater, 2-fold or greater, 3-fold or greater, 4-fold or greater, 5-fold or greater, 6-fold or greater, 7-fold or greater, 8-fold or greater, 9-fold or greater, 10-fold or greater, 20-fold or greater, 30-fold or greater, 40-fold or greater, 50-fold or greater, 60-fold or greater, 70-fold or greater, 80-fold or greater, 90-fold or greater, 100-fold or greater, 200-fold or greater, 300-fold or greater, 400-fold or greater, 500-fold or greater, 600-fold or greater, 700-fold or greater, 800-fold or greater, 900-fold or greater, 1000-fold or greater, 10000-fold or greater, or 100000-fold or greater.

Within the scope of Disclosure A described herein, the extent that the "binding activity to FcγRIIa (type H) and FcγRIIa (type R) is reduced" or the "reduced binding activity to FcγRIIa (type H) and FcγRIIa (type R)" can be, but is not limited to, 99% or less, 98% or less, 97% or less, 96% or less, 95% or less, 94% or less, 93% or less, 92% or less, 91% or less, 90% or less, 88% or less, 86% or less, 84% or less, 82% or less, 80% or less, 78% or less, 76% or less, 74% or less, 72% or less, 70% or less, 68% or less, 66% or less, 64% or less, 62% or less, 60% or less, 58% or less, 56% or less, 54% or less, 52% or less, 50% or less, 45% or less, 40% or less, 35% or less, 30% or less, 25% or less, 20% or less, 15% or less, 10% or less, 5% or less, 4% or less, 3% or less, 2% or less, 1% or less, 0.5% or less, 0.4% or less, 0.3% or less, 0.2% or less, 0.1% or less, 0.05% or less, 0.01% or less, or 0.005% or less.

Within the scope of Disclosure A described herein, modifications that increase binding selectivity to FcγRIIb over FcγRIIa (type R) may be preferred, and modifications that increase binding selectivity to FcγRIIb over FcγRIIa (type H) may be more preferred, and as reported in WO2013/047752, preferred amino acid substitutions for such modifications may include, for example, according to EU numbering: (a) modification by substituting Gly at position 237 with Trp; (b) modification by substituting Gly at position 237 with Phe; (c) modification by substituting Pro at position 238 with Phe; (d) modification by substituting Asn at position 325 with Met; (e) modification by substituting Ser at position 267 with Ile; (f) modification by substituting Leu at position 328 with Asp; (g) modification by substituting Ser at position 267 with Val; (h) modification by substituting Leu at position 328 with Trp; (i) modification by substituting Ser at position 267 with Gln; (j) modification by substituting Ser at position 267 with Met; (k) modification by substituting Gly at position 236 with Asp; (1) modification by substituting Ala at position 327 with Asn; (m) modification by substituting Asn at position 325 with Ser; (n) modification by substituting Leu at position 235 with Tyr; (o) modification by substituting Val at position 266 with Met; (p) modification by substituting Leu at position 328 with Tyr; (q) modification by substituting Leu at position 235 with Trp; (r) modification by substituting Leu at position 235 with Phe; (s) modification by substituting Ser at position 239 with Gly; (t) modification by substituting Ala at position 327 with Glu; (u) modification by substituting Ala at position 327 with Gly; (v) modification by substituting Pro at position 238 with Leu; (w) modification by substituting Ser at position 239 with Leu; (x) modification by substituting Leu at position 328 with Thr; (y) modification by substituting Leu at position 328 with Ser; (z) modification by substituting Leu at position 328 with Met; (aa) modification by substituting Pro at position 331 with Trp; (ab) modification by substituting Pro at position 331 with Tyr; (ac) modification by substituting Pro at position 331 with Phe; (ad) modification by substituting Ala at position 327 with Asp; (ae) modification by substituting Leu at position 328 with Phe; (af) modification by substituting Pro at position 271 with Leu; (ag) modification by substituting Ser at position 267 with Glu; (ah) modification by substituting Leu at position 328 with Ala; (ai) modification by substituting Leu at position 328 with Ile; (aj) modification by substituting Leu at position 328 with Gln; (ak) modification by substituting Leu at position 328 with Val; (al) modification by substituting Lys at position 326 with Trp; (am) modification by substituting Lys at position 334 with Arg; (an) modification by substituting His at position 268 with Gly; (ao) modification by substituting His at position 268 with Asn; (ap) modification by substituting Ser at position 324 with Val; (aq) modification by substituting Val at position 266 with Leu; (ar) modification by substituting Pro at position 271 with Gly; (as) modification by substituting Ile at position 332 with Phe; (at) modification by substituting Ser at position 324 with Ile; (au) modification by substituting Glu at position 333 with Pro; (av) modification by substituting Tyr at position 300 with Asp; (aw) modification by substituting Ser at position 337 with Asp; (ax) modification by substituting Tyr at position 300 with Gln; (ay) modification by substituting Thr at position 335 with Asp; (az) modification by substituting Ser at position 239 with Asn; (ba) modification by substituting Lys at position 326 with Leu; (bb) modification by substituting Lys at position 326 with Ile; (bc) modification by substituting Ser at position 239 with Glu; (bd) modification by substituting Lys at position 326 with Phe; (be) modification by substituting Lys at position 326 with Val; (bf) modification by substituting Lys at position 326 with Tyr; (bg) modification by substituting Ser at position 267 with Asp; (bh) modification by substituting Lys at position 326 with Pro; (bi) modification by substituting Lys at position 326 with His; (bj) modification by substituting Lys at position 334 with Ala; (bk) modification by substituting Lys at position 334 with Trp; (bl) modification by substituting His at position 268 with Gln; (bm) modification by substituting Lys at position 326 with Gln; (bn) modification by substituting Lys at position 326 with Glu; (bo) modification by substituting Lys at position 326 with Met; (bp) modification by substituting Val at position 266 with Ile; (bq) modification by substituting Lys at position 334 with Glu; (br) modification by substituting Tyr at position 300 with Glu; (bs) modification by substituting Lys at position 334 with Met; (bt) modification by substituting Lys at position 334 with Val; (bu) modification by substituting Lys at position 334 with Thr; (bv) modification by substituting Lys at position 334 with Ser; (bw) modification by substituting Lys at position 334 with His; (bx) modification by substituting Lys at position 334 with Phe; (by) modification by substituting Lys at position 334 with Gln; (bz) modification by substituting Lys at position 334 with Pro; (ca) modification by substituting Lys at position 334 with Tyr; (cb) modification by substituting Lys at position 334 with Ile; (cc) modification by substituting Gln at position 295 with Leu; (cd) modification by substituting Lys at position 334 with Leu; (ce) modification by substituting Lys at position 334 with Asn; (cf) modification by substituting His at position 268 with Ala; (cg) modification by substituting Ser at position 239 with Asp; (ch) modification by substituting Ser at position 267 with Ala; (ci) modification by substituting Leu at position 234 with Trp; (cj) modification by substituting Leu at position 234 with Tyr; (ck) modification by substituting Gly at position 237 with Ala; (cl) modification by substituting Gly at position 237 with Asp; (cm) modification by substituting Gly at position 237 with Glu; (cn) modification by substituting Gly at position 237 with Leu; (co) modification by substituting Gly at position 237 with Met; (cp) modification by substituting Gly at position 237 with Tyr; (cq) modification by substituting Ala at position 330 with Lys; (cr) modification by substituting Ala at position 330 with Arg; (cs) modification by substituting Glu at position 233 with Asp; (ct) modification by substituting His at position 268 with Asp; (cu) modification by substituting His at position 268 with Glu; (cv) modification by substituting Lys at position 326 with Asp; (cw) modification by substituting Lys at position 326 with Ser; (cx) modification by substituting Lys at position 326 with Thr; (cy) modification by substituting Val at position 323 with Ile; (cz) modification by substituting Val at position 323 with Leu; (da) modification by substituting Val at position 323 with Met; (db) modification by substituting Tyr at position 296 with Asp; (dc) modification by substituting Lys at position 326 with Ala; (dd) modification by substituting Lys at position 326 with Asn; and (de) modification by substituting Ala at position 330 with Met.

The modifications described above may be at a single position alone or at two or more positions in combination. Alternatively, such preferred modifications may include, for example, those shown in Tables 14 to 15, 17 to 24, and 26 to 28 of WO2013/047752, for example, variants of human constant region or human Fc region, in which the amino acid at position 238 according to EU numbering is Asp and the amino acid at position 271 according to EU numbering is Gly in human IgG (IgG1, IgG2, IgG3, or IgG4); in addition, one or more of position(s) 233, 234, 237, 264, 265, 266, 267, 268, 269, 272, 296, 326, 327, 330, 331, 332, 333, and 396, according to EU numbering may be substituted. In this case, the variants may include, but are not limited to, variants of human constant region or human Fc region that contain one or more of:

Asp at position 233, Tyr at position 234, Asp at position 237, Ile at position 264, Glu at position 265, any one of Phe, Met, and Leu at position 266, any one of Ala, Glu, Gly, and Gln at position 267, either Asp or Glu at position 268, Asp at position 269, any one of Asp, Phe, Ile, Met, Asn, and Gln at position 272, Asp at position 296, either Ala or Asp at position 326, Gly at position 327, either Lys or Arg at position 330, Ser at position 331, Thr at position 332, any one of Thr, Lys, and Arg at position 333, and any one of Asp, Glu, Phe, Ile, Lys, Leu, Met, Gln, Arg, and Tyr at position 396, according to EU numbering.

In an alternative embodiment, antibodies of Disclosure A containing an Fc region variant or constant region variant may have maintained or increased binding activity to FcγRIIb and reduced binding activity to FcγRIIa (type H) and FcγRIIa (type R) as compared to a reference antibody containing the constant region or Fc region of a native IgG. Preferred sites of amino acid substitution for such variants may be, as reported in WO2014/030728, for example, the amino acid at position 238 according to EU numbering and at least one amino acid position selected from the group consisting of position 233, 234, 235, 237, 264, 265, 266, 267, 268, 269, 271, 272, 274, 296, 326, 327, 330, 331, 332, 333, 334, 355, 356, 358, 396, 409, and 419, according to EU numbering.

More preferably, the variants may have Asp at position 238 according to EU numbering, and at least one amino acid selected from the amino acid group of: Asp at position 233, Tyr at position 234, Phe at position 235, Asp at position 237, Ile at position 264, Glu at position 265, Phe, Leu, or Met at position 266, Ala, Glu, Gly, or Gln at position 267, Asp, Gln, or Glu at position 268, Asp at position 269, Gly at position 271, Asp, Phe, Ile, Met, Asn, Pro, or Gln at position 272, Gln at position 274, Asp or Phe at position 296, Ala or Asp at position 326, Gly at position 327, Lys, Arg, or Ser at position 330, Ser at position 331, Lys, Arg, Ser, or Thr at position 332, Lys, Arg, Ser, or Thr at position 333, Arg, Ser, or Thr at position 334, Ala or Gln at position 355, Glu at position 356, Met at position 358, Ala, Asp, Glu, Phe, Gly, His, Ile, Lys, Leu, Met, Asn, Gln, Arg, Ser, Thr, Val, Trp, or Tyr at position 396, Arg at position 409, and Glu at position 419, according to EU numbering.

In an alternative embodiment, antibodies of Disclosure A containing an Fc region variant or constant region variant may have maintained binding activity to FcγRIIb and reduced binding activity to all activating FcγRs, FcγRIIa (type R) in particular, as compared to a reference antibody containing the constant region or Fc region of a native IgG. Preferred sites of amino acid substitution for such variants may be, as reported in WO2014/163101, for example, in addition to the amino acid at position 238 according to EU numbering), at least one amino acid position selected from positions 235, 237, 241, 268, 295, 296, 298, 323, 324, and 330, according to EU numbering. More preferably, the variants may have Asp at position 238 according to EU numbering, and at least one amino acid selected from the amino acid group of: Phe at position 235; Gln or Asp at position 237; Met or Leu at position 241; Pro at position 268; Met or Val at position 295; Glu, His, Asn, or Asp at position 296; Ala or Met at position 298; Ile at position 323; Asn or His at position 324; and His or Tyr at position 330, according to EU numbering.

Within the scope of Disclosure A described herein, the level of the "maintained binding activity to FcγRIIb" can be, but is not limited to, 55% or greater, 60% or greater, 65% or greater, 70% or greater, 75% or greater, 80% or greater, 81% or greater, 82% or greater, 83% or greater, 84% or greater, 85% or greater, 86% or greater, 87% or greater, 88% or greater, 89% or greater, 90% or greater, 91% or greater, 92% or greater, 93% or greater, 94% or greater, 95% or greater, 96% or greater, 97% or greater, 98% or greater, 99% or greater, 99.5% or greater, 100% or greater, 101% or greater, 102% or greater, 103% or greater, 104% or greater, 105% or greater, 106% or greater, 107% or greater, 108% or greater, 109% or greater, 110% or greater, 120% or greater, 130% or greater, 140% or greater, 150% or greater, 175% or greater, or 2-fold or greater.

Within the scope of Disclosure A described herein, the level of the aforementioned "reduced binding activity to all activating FcγRs, FcγRIIa (type R) in particular" can be, but is not limited to, 74% or less, 72% or less, 70% or less, 68% or less, 66% or less, 64% or less, 62% or less, 60% or less, 58% or less, 56% or less, 54% or less, 52% or less, 50% or less, 45% or less, 40% or less, 35% or less, 30% or less, 25% or less, 20% or less, 15% or less, 10% or less, 5% or less, 4% or less, 3% or less, 2% or less, 1% or less, 0.5% or less, 0.4% or less, 0.3% or less, 0.2% or less, 0.1% or less, 0.05% or less, 0.01% or less, or 0.005% or less.

WO2014/030750 also reports variants of the mouse constant region and Fc region. In an embodiment, antibodies of Disclosure A or B may comprise such a variant.

Within the scope of Disclosures A and B described herein, unlike FcγR which belongs to the immunoglobulin superfamily, "FcRn", in particular human FcRn, is structurally similar to polypeptides of major histocompatibility complex (MEW) class I, and exhibits 22% to 29% sequence identity with MEW class I molecules (Ghetie et al., *Immunol. Today* 18(12), 592-598 (1997)). FcRn is expressed as a heterodimer consisting of a soluble β or light chain (β2 microglobulin) complexed with a transmembrane a or heavy chain. Like MHC, the α chain of FcRn contains three extracellular domains (α1, α2, and α3), and its short cytoplasmic domain tethers proteins to the cell surface. α1 and α2 domains interact with the FcRn-binding domain of the antibody Fc region (Raghavan et al., *Immunity* 1:303-315 (1994)).

FcRn is expressed in the maternal placenta and yolk sac of mammals, and is involved in mother-to-fetus IgG transfer. In addition, in the small intestines of neonatal rodents where FcRn is expressed, FcRn is involved in transfer of maternal IgG across brush border epithelium from ingested colostrum or milk. FcRn is expressed in a variety of other tissues and endothelial cell systems of various species. FcRn is also expressed in adult human vascular endothelia, muscle vascular system, and liver sinusoidal capillaries. FcRn is believed to play a role in maintaining the plasma IgG concentration by binding to IgG and recycling the IgG to serum. Typically, binding of FcRn to IgG molecules is strictly pH dependent. The optimal binding is observed in an acidic pH range below 7.0.

The polynucleotide and amino acid sequences of human FcRn may be derived, for example, from the precursors shown in NM_004107.4 and NP_004098.1 (containing the signal sequence), respectively (RefSeq accession numbers are shown in parentheses).

The precursors form complexes with human β2-microglobulin in vivo. Thus, by using known recombinant expression techniques, soluble human FcRn capable of forming a complex with human β2-microglobulin may be produced for appropriate use in various experimental systems. Such soluble human FcRn may be used to assess antibodies or Fc region variants for their FcRn-binding activity. In Disclosure A or B, FcRn is not particularly limited as long as it is in a form which can bind to the FcRn-binding domain; however, preferred FcRn may be human FcRn.

Within the scope of Disclosures A and B described herein, where an antibody or Fc region variant has FcRn-binding activity, it may have an "FcRn-binding domain", preferably a human FcRn-binding domain. The FcRn-binding domain is not particularly limited as long as the antibody has binding activity to or affinity for FcRn at an acidic pH and/or at a neutral pH; or it may be a domain that has the activity to directly or indirectly bind to FcRn. Such domains include, but are not limited to, the Fc regions of IgG-type immunoglobulins, albumin, albumin domain 3, anti-FcRn antibodies, anti-FcRn peptides, and anti-FcRn Scaffold molecules, which have the activity of directly binding to FcRn, and molecules that bind to IgG or albumin, which have the activity of binding to FcRn indirectly. In Disclosure A or B, it is also possible to use domains that have FcRn-binding activity in an acidic pH range and/or in a neutral pH range. If the domains have FcRn-binding activity in an acidic pH range and/or in a neutral pH range originally, they can be used without further modification. If the domains have only a weak or no FcRn-binding activity in an acidic pH range and/or in a neutral pH range, amino acid residues in the FcRn-binding domain of the antibody or Fc region variant may be modified to have FcRn-binding activity in an acidic pH range and/or in a neutral pH range. Alternatively, amino acids of domains that originally have FcRn-binding activity in an acidic pH range and/or in a neutral pH range may be modified to further increase their FcRn-binding activity. The FcRn-binding activity in an acidic pH range and/or in a neutral pH range can be compared before and after amino acid modification to find amino acid modifications of interest for the FcRn-binding domains.

FcRn-binding domains may be preferably regions that directly bind to FcRn. Such preferred FcRn-binding domains include, for example, constant regions and Fc regions of antibodies. However, regions capable of binding to a polypeptide having FcRn-binding activity, such as albumin and IgG, can indirectly bind to FcRn via albumin, IgG. Thus, the FcRn-binding regions may be regions that bind to a polypeptide that has binding activity to albumin or IgG. Without limitations, to promote antigen elimination from plasma, FcRn-binding domains whose FcRn-binding activity is greater at a neutral pH are preferred, while to improve antibody retention in plasma, FcRn-binding domains whose FcRn-binding activity is greater at an acidic pH are preferred. For example, it is possible to select FcRn-binding domains whose FcRn-binding activity is originally greater at a neutral pH or acidic pH. Alternatively, amino acids of an antibody or Fc region variant may be modified to confer FcRn-binding activity at a neutral pH or acidic pH. Alternatively, it is possible to increase the pre-existing FcRn-binding activity at a neutral pH or acidic pH.

Within the scope of Disclosures A and B described herein, whether the FcRn-binding activity of an antibody or Fc region (variant) is increased, (substantially) maintained, or reduced as compared to that of the antibody or Fc region (variant) before modification can be assessed by known methods such as those described in the Examples herein, and for example, BIACORE, Scatchard plot and flow cytometer (see WO2013/046722). The extracellular domain of human FcRn may be used as a soluble antigen in these assays. Those of ordinary skill in the art can appropriately select the conditions besides pH in measuring the FcRn-binding activity of an antibody or Fc region (variant). The assay can be carried out, for example, under the conditions of MES buffer and 37° C., as described in WO2009/125825. The FcRn-binding activity of an antibody or Fc region (variant) can be assessed, for example, by loading FcRn as an analyte on an antibody-immobilized chip.

The FcRn-binding activity of an antibody or Fc region (variant) can be assessed based on the dissociation constant (KD), apparent dissociation constant (apparent KD), dissociation rate (kd), apparent dissociation (apparent kd).

As for the pH conditions for measuring the binding activity between FcRn and the FcRn-binding domain contained in an antibody or Fc region (variant), acidic pH condition or neutral pH condition may be suitably used. As for the temperature conditions for measuring the binding activity (binding affinity) between FcRn and the FcRn-binding domain, any temperature of 10° C. to 50° C. may be used. To determine the binding activity (binding affinity) between FcRn and the human FcRn-binding domain, preferably a temperature of 15° C. to 40° C. may be used. More preferably, any temperature from 20° C. to 35° C. such as any one of 20, 21, 22, 23, 24, 25, 26, 27, 28, 29, 30, 31, 32, 33, 34, and 35° C. may be used. A non-limiting example of such temperature can be 25° C.

In one embodiment, where antibodies of Disclosure A or B have FcRn-binding activity, they may have an FcRn-binding domain, preferably a human FcRn-binding domain. The FcRn-binding domain is not particularly limited as long as the antibodies have binding activity to or affinity for FcRn at an acidic pH and/or a neutral pH, and it may be a domain that has an activity of directly or indirectly binding to FcRn. In one specific embodiment, it may be preferable that the antibody of Disclosure A or B has, for example, an increased FcRn-binding activity under a neutral pH condition as compared to a reference antibody containing the constant region of a native IgG (see WO2013/046722). From the perspective of comparing the FcRn-binding activity between the two, it may be preferable that, without limitations, the antibody of Disclosure A or B and the reference antibody containing the constant region of a native IgG have identical amino acid sequences in the regions (for example, the variable region) other than, preferably, the constant region of the antibody of Disclosure A or B which has been modified at one or more amino acid residues.

In one embodiment, within the scope of Disclosure A described herein, where an antibody of Disclosure A has an increased FcRn-binding activity under a neutral pH condition, without being bound by a particular theory, the antibody of Disclosure A may possess any two or more of the following properties in combination: the property of being shuttled between plasma and cellular endosome and repeatedly binding to multiple antigens as a single antibody molecule by having an ion concentration-dependent antigen-binding domain; the property of being rapidly taken up into cells by having increased pI and increased positive charge in the overall antibody; and the property of being rapidly taken up into cells by having an increased FcRn-binding activity under a neutral pH condition. As a result, the antibody half-life in plasma can be further shortened, or the binding activity of the antibody toward the extracellular matrix can be further increased, or antigen elimination from plasma can be further promoted. Those of ordinary skill in the art can determine an optimal pI value for the antibody of Disclosure A to take advantage of these properties.

Within the scope of Disclosures A and B described herein, according to the Yeung et al. (*J. Immunol.* 182:7663-7671 (2009)), the activity of a native human IgG1 to bind to human FcRn is KD 1.7 µM in an acidic pH range (pH 6.0), whereas in a neutral pH range the activity is almost undetectable. Thus, to increase the FcRn-binding activity in a neutral pH range, it may preferable to use, as an antibody of Disclosure A or B: an antibody or a constant region variant or Fc region variant whose human FcRn-binding activity in an acidic pH range is KD 20 µM or stronger and whose human FcRn-binding activity in a neutral pH range is comparable to or stronger than that of a native human IgG; preferably an antibody or a constant region variant or Fc region variant whose human FcRn-binding activity in an acidic pH range is KD 2.0 µM or stronger and whose human FcRn-binding activity in a neutral pH range is KD 40 µM or stronger; and more preferably an antibody or a constant region variant or Fc region variant whose human FcRn-binding activity in an acidic pH range is KD 0.5 µM or stronger and whose human FcRn-binding activity in a neutral pH range is KD 15 µM or stronger. The KD values are determined by the method described in Yeung et al. (*J. Immunol.* 182:7663-7671 (2009) (by immobilizing an antibody onto a chip and loading human FcRn as an analyte)).

Within the scope of Disclosures A and B described herein, a domain of any structure that binds to FcRn can be used as an FcRn-binding domain. In this case, the FcRn-binding domain can be produced without the need to introduce an amino acid modification, or the affinity for FcRn may be increased by introducing an additional modification.

Within the scope of Disclosures A and B described herein, the starting FcRn-binding domain can include for example, the Fc region or constant region of (human) IgG. As long as a variant of the starting Fc region or starting constant region can bind to FcRn in an acidic pH range and/or in a neutral pH range, any Fc region or constant region can be used as the starting Fc region or starting constant region. Or, an Fc region or constant region obtained by further modifying a starting Fc region or starting constant region whose amino acid residues have been already modified from an Fc region or constant region can also be appropriately used as the Fc region or constant region. The starting Fc region or starting constant region may include known Fc regions produced by recombination. A starting Fc region or starting constant region may refer to the polypeptide itself, a composition containing the starting Fc region or starting constant region, or an amino acid sequence encoding the starting Fc region or starting constant region, depending on the context. The origin of the starting Fc region or starting constant region is not limited, and it can be obtained from any organism of nonhuman animals or from a human. Furthermore, the starting FcRn-binding domain can be obtained from cynomolgus monkeys, marmosets, Rhesus monkeys, chimpanzees, and humans. Starting Fc regions or starting constant regions may be obtained from human IgG1, but are not limited to any particular IgG class. This means that an Fc region of human IgG1, IgG2, IgG3, or IgG4 can be used as an appropriate starting FcRn-binding domain, and an Fc region or constant region of an IgG class or subclass derived from any organism can be used as a starting Fc region or as a starting constant region. Examples of native IgG variants or modified forms are described in, for example, Strohl, *Curr. Opin. Biotechnol.* 20(6):685-691 (2009); Presta, *Curr. Opin. Immunol.* 20(4):460-470 (2008); Davis et al., *Protein Eng. Des. Sel.* 23(4):195-202 (2010), WO2009/086320, WO2008/092117; WO2007/041635; and WO2006/105338).

Within the scope of Disclosures A and B described herein, amino acid residues of the starting FcRn-binding domain, starting Fc region, or starting constant region may contain, for example, one or more mutations: for example, substitution mutations with amino acid residues that are different from the amino acid residues in the starting Fc region or starting constant region; insertions of one or more amino acid residues into the amino acid residues in the starting Fc region or starting constant region; or deletions of one or more amino acid residues from the amino acid residues of the starting Fc region or starting constant region. The amino acid sequences of Fc regions or constant regions after modifications may be preferably amino acid sequences containing at least a portion of an Fc region or constant region that does not occur naturally. Such variants necessarily have a sequence identity or similarity of less than 100% to the starting Fc regions or starting constant regions. For example, the variants have an amino acid sequence identity or similarity of about 75% to less than 100%, more preferably about 80% to less than 100%, even more preferably about 85% to less than 100%, still more preferably about 90% to less than 100%, and yet more preferably about 95% to less than 100% to the amino acid sequence of the starting Fc region or starting constant region. In a non-limiting example, at least one amino acid is different between a modified Fc region or constant region of Disclosure A or B and the starting Fc region or starting constant region.

Within the scope of Disclosures A and B described herein, an Fc region or constant region that has FcRn-binding activity in an acidic pH range and/or in a neutral pH range may be obtained by any method. Specifically, a variant of Fc region or constant region that has FcRn-binding activity in an acidic pH range and/or in a neutral pH range may be obtained by modifying amino acids of a human IgG-type antibody which can be used as the starting Fc region or starting constant region. IgG-type antibody Fc regions or constant regions suitable for modification include, for example, the Fc regions or constant regions of human IgG (IgG1, IgG2, IgG3, and IgG4, and variants thereof), and mutants spontaneously generated therefrom are also included in the IgG Fc regions or constant regions. For the Fc regions or constant regions of human IgG1, human IgG2, human IgG3, and human IgG4 antibodies, a number of allotype sequences due to genetic polymorphism are described in "Sequences of proteins of immunological interest", NIH Publication No. 91-3242, and any of them may be used in Disclosure A or B. In particular, for the human IgG1 sequence, the amino acid sequence of positions 356 to 358 according to EU numbering may be DEL or EEM.

In one embodiment of Disclosure A or B, the modification into other amino acids is not particularly limited, as long as the resulting variants have FcRn-binding activity in an acidic pH range and/or in a neutral pH range, and preferably in a neutral pH range. Sites of amino acid modification to increase the FcRn-binding activity under a neutral pH condition are described, for example, in WO2013/046722. Such modification sites include, for example, one or more positions selected from the group consisting of: position 221 to 225, 227, 228, 230, 232, 233 to 241, 243 to 252, 254 to 260, 262 to 272, 274, 276, 278 to 289, 291 to 312, 315 to 320, 324, 325, 327 to 339, 341, 343, 345, 360, 362, 370, 375 to 378, 380, 382, 385 to 387, 389, 396, 414, 416, 423, 424, 426 to 438, 440, and 442, according to EU numbering in the Fc region or constant region of a human IgG antibody, as described in WO2013/046722. WO2013/046722 also describes, as a part of the preferred modifications in the Fc region or constant region, for example, modification of one or more amino acids selected from the group consisting of: the amino acid at position 256 to Pro, the amino acid at position 280 to Lys, the amino acid at position 339 to Thr, the amino acid at position 385 to His, the amino acid at position 428 to Leu, and the amino acid at position 434 to Trp, Tyr, Phe, Ala, or His, according to EU numbering. The number of amino acids to be modified is not particularly limited, and modification may be performed at a single position alone or at two or more positions. Modification of these amino acid residues can enhance the FcRn binding of the Fc region or constant region of an IgG-type antibody under a neutral pH condition. Modification of these amino acid residues may also be introduced appropriately into antibodies of Disclosure A or B.

In a further or alternative embodiment, it is also possible to use appropriate amino acid modification sites for increasing the FcRn-binding activity under an acidic pH condition. Among such modification sites, one or more modification sites that allow an increase in the FcRn binding also in a neutral pH range can be appropriately used in Disclosure A or B. Such modification sites include, for example, those reported in WO2011/122011, WO2013/046722, WO2013/046704, and WO2013/046722. The sites of amino acids that allow such modification of the constant region or Fc region of a human IgG-type antibody and the types of amino acids after modification are reported in Table 1 of WO2013/046722. WO2013/046722 also describes, as particularly preferred, modification sites in the constant region or Fc region, for example, the location of one or more amino acid positions selected from the group consisting of position 237, 238, 239, 248, 250, 252, 254, 255, 256, 257, 258, 265, 270, 286, 289, 297, 298, 303, 305, 307, 308, 309, 311, 312, 314, 315, 317, 325, 332, 334, 360, 376, 380, 382, 384, 385, 386, 387, 389, 424, 428, 433, 434, and 436, according to EU numbering. Modification of these amino acid residue positions can also enhance the human FcRn binding of the FcRn-binding domain in a neutral pH range. WO2013/046722 also describes, as a part of the preferred modification in the IgG-type constant region or Fc region, for example, modification of one or more amino acid residues selected from the group consisting of: (a) the amino acid at position 237 to Met; (b) the amino acid at position 238 to Ala; (c) the amino acid at position 239 to Lys; (d) the amino acid at position 248 to Ile; (e) the amino acid at position 250 to any one of Ala, Phe, Ile, Met, Gln, Ser, Val, Trp, and Tyr; (f) the amino acid at position 252 to any one of Phe, Trp, and Tyr; (g) the amino acid at position 254 to Thr; (h) the amino acid at position 255 to Glu; (i) the amino acid at position 256 to any one of Asp, Glu, and Gln; (j) the amino acid at position 257 to any one of Ala, Gly, Ile, Leu, Met, Asn, Ser, Thr, and Val; (k) the amino acid at position 258 to His; (l) the amino acid at position 265 to Ala; (m) the amino acid at position 270 to Phe; (n) the amino acid at position 286 to either Ala or Glu; (o) the amino acid at position 289 to His; (p) the amino acid at position 297 to Ala; (q) the amino acid at position 298 to Gly; (r) the amino acid at position 303 to Ala; (s) the amino acid at position 305 to Ala; (t) the amino acid at position 307 to any one of Ala, Asp, Phe, Gly, His, Ile, Lys, Leu, Met, Asn, Pro, Gln, Arg, Ser, Val, Trp, and Tyr; (u) the amino acid at position 308 to any one of Ala, Phe, Ile, Leu, Met, Pro, Gln, and Thr; (v) the amino acid at position 309 to any one of Ala, Asp, Glu, Pro, and Arg; (w) the amino acid at position 311 to any one of Ala, His, and Ile; (x) the amino acid at position 312 to either Ala or His; (y) the amino acid at position 314 to either Lys or Arg; (z) the amino acid at position 315 to either Ala or His; (aa) the amino acid at position 317 to Ala; (ab) the amino acid at position 325 to Gly; (ac) the amino acid at position 332 to Val; (ad) the amino acid at position 334 to Leu; (ae) the amino acid at position 360 to His; (af) the amino acid at position 376 to Ala; (ag) the amino acid at position 380 to Ala; (ah) the amino acid at position 382 to Ala; (ai) the amino acid at position 384 to Ala; (aj) the amino acid at position 385 to either Asp or His; (ak) the amino acid at position 386 to Pro; (al) the amino acid at position 387 to Glu; (am) the amino acid at position 389 to either Ala or Ser; (an) the amino acid at position 424 to Ala; (ao) the amino acid at position 428 to any one of Ala, Asp, Phe, Gly, His, Ile, Lys, Leu, Asn, Pro, Gln, Ser, Thr, Val, Trp, and Tyr; (ap) the amino acid at position 433 to Lys; (aq) the amino acid at position 434 to Ala, Phe, His, Ser, Trp, and Tyr; and (ar) the amino acid at position 436 to His; according to EU numbering. The number of amino acids to be modified is not particularly limited, and modification may be performed at a single position alone or at two or more positions. Combinations of amino acid modifications at two or more positions include, for example, those shown in Table 2 of WO2013/046722. Modification of these amino acid residues may also be appropriately introduced into antibodies of Disclosures A and B.

In one embodiment, the FcRn-binding activity of the FcRn-binding domain of an antibody of Disclosure A or B has been increased when compared to that of a reference antibody containing an Fc region or constant region of a native IgG or that of a reference antibody containing a starting Fc region or starting constant region. Namely, the FcRn-binding activity of an Fc region variant or constant region variant of Disclosure A or B, or an antibody containing such variant is greater than that of the reference antibody). This can mean that when compared to the FcRn-binding activity of the reference antibody, that of an antibody of Disclosure A or B can be, for example: 55% or greater, 60% or greater, 65% or greater, 70% or greater, 75% or greater, 80% or greater, 85% or greater, 90% or greater, 95% or greater, 100% or greater, 105% or greater, preferably 110% or greater, 115% or greater, 120% or greater, 125% or greater, more preferably 130% or greater, 135% or greater, 140% or greater, 145% or greater, 150% or greater, 155% or greater, 160% or greater, 165% or greater, 170% or greater, 175% or greater, 180% or greater, 185% or greater, 190% or greater, 195% or greater, 2-fold or greater, 2.5-fold or greater, 3-fold or greater, 3.5-fold or greater, 4-fold or greater, 4.5-fold or greater, or 5-fold or greater.

In one embodiment, amino acid sequences to be modified in an antibody of Disclosure A or B can preferably contain human sequences (sequences found in native human-derived antibodies) in order to not increase the immunogenicity of the antibody when the antibody is administered in vivo (preferably, into a human body). Alternatively, after modification, mutations may be introduced at positions other than the sites of amino acid modification in such a way that one or more of the FRs (FR1, FR2, FR3, and FR4) is substituted with a human sequence. Methods for substituting FR(s) with a human sequence are known in the art and include, but are not limited to that reported in Ono et al., *Mol. Immunol.* 36(6):387-395 (1999). Humanization methods are known in the art and include, but are not limited to that reported in, *Methods* 36(1):43-60 (2005).

In one embodiment, the framework region sequences (also referred to as "FR sequences") of the heavy chain and/or light chain variable region of an antibody of Disclosure A or B may contain human germ-line framework sequences. When the framework sequences are completely human germ-line sequences, the antibody is expected to induce little or no immunogenic reaction when administered to humans (for example, to treat or prevent a certain disease).

FR sequences preferably can include, for example, fully human FR sequences such as those shown in V-Base (vbase.mrc-cpe.cam.ac.uk/). These FR sequences can be appropriately used for Disclosure A or B. The germ-line sequences may be categorized based on their similarity (Tomlinson et al. (*J. Mol. Biol.* 227:776-798 (1992); Williams et al. (*Eur. J. Immunol.* 23:1456-1461 (1993); and Cox et al. (*Nat. Genetics* 7:162-168 (1994)). Preferred germ-line sequences can be appropriately selected from Vκ, which is categorized into seven subgroups; Vλ, which is categorized into ten subgroups; and VH, which is categorized into seven subgroups.

Fully human VH sequences can preferably include, for example, VH sequences of: subgroup VH1 (for example, VH1-2, VH1-3, VH1-8, VH1-18, VH1-24, VH1-45, VH1-46, VH1-58, and VH1-69); subgroup VH2 (for example, VH2-5, VH2-26, and VH2-70); subgroup VH3 (VH3-7, VH3-9, VH3-11, VH3-13, VH3-15, VH3-16, VH3-20, VH3-21, VH3-23, VH3-30, VH3-33, VH3-35, VH3-38, VH3-43, VH3-48, VH3-49, VH3-53, VH3-64, VH3-66, VH3-72, VH3-73, and VH3-74); subgroup VH4 (VH4-4, VH4-28, VH4-31, VH4-34, VH4-39, VH4-59, and VH4-61); subgroup VH5 (VH5-51); subgroup VH6 (VH6-1); or subgroup VH7 (VH7-4 and VH7-81). These are also described in, for example, Matsuda et al. (*I Exp. Med.* 188:1973-1975 (1998)), and those of ordinary skill in the art can appropriately design antibodies based on information of these sequences. It can be also preferable to use other fully human FR sequence or sequences of regions that are equivalent thereto.

Fully human Vκ sequences can preferably include, for example: A20, A30, L1, L4, L5, L8, L9, L11, L12, L14, L15, L18, L19, L22, L23, L24, O2, O4, O8, O12, O14, or O18, which are classified as subgroup Vk1; A1, A2, A3, A5, A7, A17, A18, A19, A23, O1, and O11, which are classified as subgroup Vk2; A11, A27, L2, L6, L10, L16, L20, and L25, which are classified as subgroup Vk3; B3, classified as subgroup Vk4; B2 (also referred to as "Vk5-2"), classified as subgroup Vk5; or A10, A14, and A26, which are classified as subgroup Vk6 (Kawasaki et al. (*Eur. J. Immunol.* 31:1017-1028 (2001)); (Hoppe Seyler *Biol. Chem.* 374: 1001-1022 (1993)); Brensing-Kuppers et al. (*Gene* 191:173-181 (1997)).

Fully human Vλ sequences can preferably include, for example: V1-2, V1-3, V1-4, V1-5, V1-7, V1-9, V1-11, V1-13, V1-16, V1-17, V1-18, V1-19, V1-20, and V1-22, which are classified as subgroup VL1; V2-1, V2-6, V2-7, V2-8, V2-11, V2-13, V2-14, V2-15, V2-17, and V2-19, which are classified as subgroup VL2; V3-2, V3-3, and V3-4, which are classified as subgroup VL3; V4-1, V4-2, V4-3, V4-4, and V4-6, which are classified as subgroup VL4; or V5-1, V5-2, V5-4, and V5-6, which are classified as subgroup VL5 (Kawasaki et al. *Genome Res.* 7:250-261 (1997)).

Normally, these FR sequences are different from one another at one or more amino acid residues. These FR sequences can be used in the modification of antibody amino acid residues. Fully human FR sequences that may be used in the modification also include, for example, KOL, NEWM, REI, EU, TUR, TEI, LAY, and POM (see, for example, aforementioned Kabat et al. (1991); Wu et al. (*J. Exp. Med.* 132:211-250 (1970)).

Within the scope of Disclosures A and B described herein, "flexible residues" can refer to amino acid residue variations that are present at positions showing high amino acid diversity at which the light chain or heavy chain variable regions have several different amino acids when the amino acid sequences of known and/or native antibodies or antigen-binding domains are compared. Positions showing high diversity are generally located in the CDRs. The data provided by Kabat, Sequences of Proteins of Immunological Interest (National Institute of Health Bethesda Md.) (1987 and 1991), can be effective in determining such positions with high diversity in known and/or native antibodies. Furthermore, several databases on the Internet (vbase.mrc-cpe.cam.ac.uk/, bioinf.org.uk/abs/index.html) provide a collection of numerous human light chain and heavy chain sequences and their locations. Information on these sequences and locations is useful to determine the locations of flexible residues. Without limitations, for example, when an amino acid residue at a particular position has a variability of, preferably, 2 to 20, 3 to 19, 4 to 18, 5 to 17, 6 to 16, 7 to 15, 8 to 14, 9 to 13, or 10 to 12 amino acid residues, the position can be judged to show (high) diversity.

In an embodiment, it can be understood that where an antibody of Disclosure A or B contains the whole or a portion of the light chain variable region and/or heavy chain variable region, the antibody may contain one or more appropriate flexible residues, if needed. For example, a heavy chain and/or light chain variable region sequence selected to have an FR sequence which originally contains amino acid residues that change the antigen-binding activity of an antibody according to the ion concentration (hydrogen ion concentration or calcium ion concentration) conditions can be designed to contain, other amino acid residues in addition to these amino acid residues. In this case, for example, the number and locations of the flexible residues can also be determined without being limited to a specific embodiment, as long as the antigen-binding activity of the antibody of Disclosure A or B changes according to the ion concentration condition. Specifically, the CDR sequence and/or FR sequence of a heavy chain and/or light chain may contain at least one flexible residue. For example, where the ion concentration is calcium ion concentration, flexible residues that can be introduced into the light-chain variable region sequence (aforementioned Vk5-2) include, but are not limited to, one or more amino acid residue positions shown in Table 1 or Table 2. Likewise, appropriate flexible residues can be introduced, for example, into an ion concentration-dependent antibody or antibody without such ion concentration dependency, containing the whole or a portion of the light chain variable region and/or heavy chain variable region, in which at least one amino acid residue that may be exposed on the antibody surface has been modified such that the pI is increased.

TABLE 1

| CDR | Kabat numbering | Amino acid in 70% of the total | | | |
|---|---|---|---|---|---|
| CDR1 | 28 | S: 100% | | | |
| | 29 | I: 100% | | | |
| | 30 | E: 72% | N: 14% | S: 14% | |
| | 31 | D: 100% | | | |
| | 32 | D: 100% | | | |
| | 33 | L: 100% | | | |
| | 34 | A: 70% | N: 30% | | |
| CDR2 | 50 | E: 100% | | | |
| | 51 | A: 100% | | | |
| | 52 | S: 100% | | | |
| | 53 | H: 5% | N: 25% | S: 45% | T: 25% |
| | 54 | L: 100% | | | |
| | 55 | Q: 100% | | | |
| | 56 | S: 100% | | | |
| CDR3 | 90 | Q: 100% | | | |
| | 91 | H: 25% | S: 15% | R: 15% | Y: 45% |
| | 92 | D: 80% | N: 10% | S: 10% | |
| | 93 | D: 5% | G: 10% | N: 25% | S: 50% | R: 10% |
| | 94 | S: 50% | Y: 50% | | |
| | 95 | P: 100% | | | |
| | 96 | L: 50% | Y: 50% | | |

(Positions are shown according to Kabat numbering.)

TABLE 2

| CDR | Kabat numbering | Amino acid in 30% of the total | | | |
|---|---|---|---|---|---|
| CDR1 | 28 | S: 100% | | | |
| | 29 | I: 100% | | | |
| | 30 | E: 83% | S: 17% | | |
| | 31 | D: 100% | | | |
| | 32 | D: 100% | | | |
| | 33 | L: 100% | | | |
| | 34 | A: 70% | N: 30% | | |
| CDR2 | 50 | H: 100% | | | |
| | 51 | A: 100% | | | |
| | 52 | S: 100% | | | |
| | 53 | H: 5% | N: 25% | S: 45% | T: 25% |
| | 54 | L: 100% | | | |
| | 55 | Q: 100% | | | |
| | 56 | S: 100% | | | |
| CDR3 | 90 | Q: 100% | | | |
| | 91 | H: 25% | S: 15% | R: 15% | Y: 45% |
| | 92 | D: 80% | N: 10% | S: 10% | |
| | 93 | D: 5% | G: 10% | N: 25% | S: 50% | R: 10% |
| | 94 | S: 50% | Y: 50% | | |
| | 95 | P: 100% | | | |
| | 96 | L: 50% | Y: 50% | | |

(Positions are shown according to Kabat numbering.)

In one embodiment, when humanizing a chimeric antibody, the pI of the chimeric antibody is increased by modifying one or more amino acid residues that can be exposed on the antibody surface as to produce a humanized antibody of Disclosure A or B with a shortened plasma half-life as compared to the chimeric antibody absent such modification. The modification of amino acid residues that can be exposed on the surface of the humanized antibody can be carried out before or concurrently with humanization of the antibody. Alternatively, by using the humanized antibody as a starting material, amino acid residues that can be exposed on the surface may be modified to further alter the pI of the humanized antibody.

Adams et al (*Cancer Immunol. Immunother.* 55(6):717-727 (2006)) reports that the humanized antibodies, trastuzumab (antigen: HER2), bevacizurnab (antigen: VEGF), and pertuzumab (antigen: HER2), which were humanized using the same human antibody FR sequences, were almost comparable in plasma pharmacokinetics. Specifically, it can be understood that the plasma pharmacokinetics is almost comparable when humanization is performed using the same FR sequences. According to one embodiment of Disclosure A, the antigen concentration in plasma is reduced by increasing the antibody's pI by modifying amino acid residues that can be exposed on the antibody surface, in addition to the humanization step. In an alternative embodiment for Disclosure A or B, human antibodies can be used. By modifying amino acid residues that can be exposed on the surface of a human antibody produced from a human antibody library, a human antibody-producing mouse, a recombinant cell, etc., and increasing the pI of the human antibody, the ability of the originally-produced human antibody to eliminate antigen from plasma can be increased.

In one embodiment, antibodies of Disclosure A may contain modified sugar chains. Antibodies with modified sugar chains include, for example, antibodies with modified glycosylation (WO99/54342), antibodies that lack fucose (WO00/61739; WO02/31140, WO2006/067847; WO2006/067913), and antibodies having sugar chains with bisecting GlcNAc (WO02/79255).

In one embodiment, antibodies of Disclosure A or B can be used, for example, in techniques for exhibiting increased antitumor activities against cancer cells or in techniques for promoting elimination of antigens that are harmful to the organism from the plasma.

In an alternative embodiment, Disclosure A or B relate to libraries of the ion concentration-dependent antigen-binding domains with an increased pI or ion concentration-dependent antibodies with an increased pI, as described above.

In an alternative embodiment, Disclosure A or B relates to nucleic acids (polynucleotides) encoding the above-described ion concentration-dependent antigen-binding domains with an increased pI or ion concentration-dependent antibodies with an increased pI. In a specific embodiment, the nucleic acids can be obtained using appropriate known methods. For specific embodiments, for example, WO2009/125825, WO2012/073992, WO2011/122011, WO2013/046722, WO2013/046704, WO2000/042072, WO2006/019447, WO2012/115241, WO2013/047752, WO2013/125667, WO2014/030728, WO2014/163101, WO2013/081143, WO2007/114319, WO2009/041643, WO2014/145159, WO2012/016227, and WO2012/093704 can be referred to, each of these are incorporated herein by reference in their entirety.

In one embodiment, nucleic acids of Disclosure A or B can be isolated or purified nucleic acids. Nucleic acids encoding the antibodies of Disclosure A or B may be any genes, and may be DNA or RNA, or other nucleic acid analogs.

Within Disclosures A and B described herein, when amino acids of an antibody are modified, the amino acid sequence of the antibody before modification may be a known sequence or the amino acid sequence of an antibody newly obtained. For example, antibodies can be obtained from antibody libraries, or by cloning nucleic acids encoding the antibody from hybridomas or B cells that produce monoclonal antibodies. The methods for obtaining nucleic acids encoding an antibody from hybridomas may use the techniques of: performing immunization by conventional immunization methods using an antigen of interest or cells expressing the antigen of interest as a sensitizing antigen; fusing the resulting immune cells with known parental cells by conventional cell fusion methods; screening for monoclonal antibody-producing cells (hybridomas) by conventional screening methods; synthesizing cDNAs of the variable region (V region) of the antibody using reverse transcriptase from mRNAs of the obtained hybridomas; and linking the cDNA to a DNA encoding an antibody constant region (C region) of interest.

Sensitizing antigens which are used to obtain nucleic acids encoding the above-described heavy chain and light chain include, but are not limited to, both complete antigens with immunogenicity and incomplete antigens including haptens which exhibit no immunogenicity. For example, it is possible to use whole proteins of interest or partial peptides of the proteins. In addition, substances that are composed of polysaccharides, nucleic acids, lipids, and other compositions known to be potential antigens. Thus, in some embodiments, antigens for the antibodies of Disclosure A or B are not particularly limited. The antigens can be prepared by, for example, baculovirus-based methods (see, e.g., WO98/46777). Hybridomas can be produced, for example, according to the method of G. Kohler and C. Milstein, *Methods Enzymol.* 73:3-46 (1981)). When the immunogenicity of an antigen is low, immunization may be performed by linking the antigen with a macromolecule having immunogenicity, such as albumin. Alternatively, if necessary, soluble antigens can be prepared by linking the antigen with other molecules. When a transmembrane molecule such as membrane antigens (for example, receptors) is used as an antigen, a portion of the extracellular region of the membrane antigen can be used as a fragment, or cells expressing the transmembrane molecule on their surface may be used as an immunogen.

In some embodiments, antibody-producing cells can be obtained by immunizing an animal with an appropriate sensitizing antigen described above. Alternatively, antibody-producing cells can be prepared by in vitro immunization of lymphocytes that are capable of producing antibodies. Various mammals can be used for immunization and other routine antibody producing procedures. Commonly used animals include rodents, lagomorphs, and primates. The animals may include, for example, rodents such as mice, rats, and hamsters; lagomorphs such as rabbits; and primates including monkeys such as cynomolgus monkeys, rhesus monkeys, baboons, and chimpanzees. In addition, transgenic animals carrying a human antibody gene repertoire are also known, and these animals can be used to obtain human antibodies (see, e.g., WO96/34096; Mendez et al., *Nat. Genet.* 15:146-156 (1997); WO93/12227, WO92/03918, WO94/02602, WO96/34096, and WO96/33735). Instead of using such transgenic animals, it is also possible to obtain desired human antibodies having antigen-binding activity by, for example, sensitizing human lymphocytes in vitro with desired antigens or cells expressing the desired antigens and then fusing the sensitized lymphocytes with human myeloma cells such as U266 (JP Pat. Publ. No. H01-59878).

Animal immunization can be carried out, for example, by appropriately diluting and suspending a sensitizing antigen in phosphate buffered saline (PBS), physiological saline, or others, and mixing it with an adjuvant to emulsify, if needed; and then injecting it intraperitoneally or subcutaneously into animals. Then, the sensitizing antigen mixed with Freund's incomplete adjuvant can be preferably administered several times every four to 21 days. Antibody production can be confirmed, for example, by measuring the titer of the antibody of interest in animal sera.

Antibody-producing cells obtained from lymphocytes or animals immunized with a desired antigen can be fused with myeloma cells to generate hybridomas using conventional fusing agents (for example, polyethylene glycol) (Goding, Monoclonal Antibodies: Principles and Practice, Academic Press, 1986, 59-103). If needed, hybridomas are cultured and expanded, and the binding specificity of antibodies produced by the hybridomas is assessed by, for instance, immunoprecipitation, radioimmunoassay (RIA), or enzyme-linked immunosorbent assay (ELISA). Then, if needed, antibody-producing hybridomas whose specificity, affinity, or activity of interest has been determined may also be subcloned by methods such as limiting dilution.

Nucleic acids encoding the selected antibody can be cloned from hybridomas or antibody-producing cells (sensitized lymphocytes, etc.) using probes that can specifically bind to the antibody (for example, oligonucleotides complementary to sequences encoding the antibody constant regions). Alternatively, the nucleic acids can be cloned from mRNA using RT-PCR. Heavy chains and light chains for use in producing antibodies of Disclosure A or B may be derived from antibodies that, for example, belong to any of Ig antibody classes and subclasses, and IgG may be preferred.

In one embodiment, nucleic acids encoding amino acid sequences that constitute the heavy chain (the whole or a portion thereof) and/or light chain (the whole or a portion thereof) of an antibody of Disclosure A or B, for example, are modified by genetic engineering techniques. Recombinant antibodies with artificial sequence modification to, for example, reduce heterologous antigenicity against humans, such as chimeric antibodies or humanized antibodies, may be appropriately generated by, for example, modifying nucleotide residues encoding amino acid sequences associated with components of antibodies such as mouse antibodies, rat antibodies, rabbit antibodies, hamster antibodies, sheep antibodies, or camel antibodies. Chimeric antibodies can be obtained, for example, by ligating a DNA encoding a mouse-derived antibody variable region with a DNA encoding a human antibody constant region and incorporating the ligated DNA coding sequence into an expression vector, then introducing the resulting recombinant vector into a host to express the genes. Humanized antibodies, which are also referred to as reshaped human antibodies, are antibodies in which human antibody FR(s) are linked in frame with antibody CDR(s) isolated from non-human mammals, such as mice, to form a coding sequence. A DNA sequence encoding such a humanized antibody can be synthesized by overlap extension PCR using a number of oligonucleotides as templates. Materials and experimental methods for overlap extension PCR are described in WO98/13388 and others. For example, a DNA encoding the amino acid sequence of, for example, an antibody variable region of Disclosure A or B may be obtained by overlap extension PCR using a number of oligonucleotides designed to have overlapping nucleotide sequences. The overlapping DNA is then linked in frame to a DNA encoding a constant region to form a coding sequence. The DNA linked as described above may be then inserted into an expression vector so that the DNA can be expressed, and the resulting vector may be introduced into a host or host cell. The antibody encoded by the DNA can be expressed by raising the host or culturing the host cells. The expressed antibody can be appropriately purified from culture media of the host or others (EP239400; WO96/02576). Furthermore, the FR(s) of a humanized antibody which are linked via CDR(s) may be selected, for example, to allow the CDRs to form an antigen-binding site suitable for the antigen. If necessary, amino acid residues that constitute FR(s) of a variable region of the selected antibody, for example, can be modified with appropriate substitution.

In one embodiment, to express antibodies of Disclosure A or B or fragments thereof, nucleic acid cassettes may be cloned into appropriate vectors. For such purposes, several types of vectors, such as phagemid vectors are available. In general, phagemid vectors can contain various elements including regulatory sequences such as promoters or signal sequences, phenotype selection genes, replication origins, and other necessary elements.

Methods for introducing desired amino acid modifications into antibodies have been established in the field of the art. For example, libraries can be constructed by introducing at least one modified amino acid residue that can be exposed on the surface of antibodies of Disclosure A or B and/or at least one amino acid that can change the antigen-binding activity of antibodies according to the ion concentration condition. Additionally, if needed, flexible residues can be added using the method of Kunkel et al. (*Methods Enzymol.* 154:367-382 (1987)).

In an alternative embodiment, Disclosure A relates to vectors containing nucleic acids encoding an above-described ion concentration-dependent antigen-binding domain with increased pI or an above-described ion concentration-dependent antibody with increased pI. In a specific embodiment, the vectors can be obtained by, for example, vectors as described in WO2009/125825, WO2012/073992, WO2011/122011, WO2013/046722, WO2013/046704, WO2000/042072, WO2006/019447, WO2012/115241, WO2013/047752, WO2013/125667, WO2014/030728, WO2014/163101, WO2013/081143, WO2007/114319, WO2009/041643, WO2014/145159, WO2012/016227, or WO2012/093704, each of which is incorporated herein by reference in their entirety.

In one embodiment, the nucleic acids encoding embodiments of Disclosure A or B may be operably cloned (inserted) into appropriate vectors and introduced into host cells. For example, when *E. coli* is used as a host, vectors include the cloning vector, pBluescript vector (Stratagene) or any of various other commercially available vectors.

In one embodiment, expression vectors are useful as vectors containing a nucleic acid for Disclosure A or B. Expression vectors can be used to allow polypeptide expression in vitro, in *E. coli*, in culture cells, or in vivo. For example, it is possible to use pBEST vector (Promega) for in vitro expression; pET vector (Invitrogen) for *E. coli* expression; pME18S-FL3 vector (GenBank Accession No. AB009864) for culture cell expression; and pME18S vector (Takebe et al., *Mol. Cell Biol.* 8:466-472 (1988)) for in vivo expression. DNAs can be inserted into vectors by conventional methods, for example, by ligase reaction using restriction enzyme sites (see, Current protocols in Molecular Biology edit. Ausubel et al. (1987) Publish. John Wiley & Sons. Section 11.4-11.11).

In an alternative embodiment, Disclosure A relates to a host or host cells that comprise a vector containing a nucleic acid encoding an above-described ion concentration-dependent antigen-binding domain with increased pI or an above-described ion concentration-dependent antibody with increased pI. In a specific embodiment, the host or host cells can be prepared by, for example, methods described in WO2009/125825, WO2012/073992, WO2011/122011, WO2013/046722, WO2013/046704, WO2000/042072, WO2006/019447, WO2012/115241, WO2013/047752, WO2013/125667, WO2014/030728, WO2014/163101, WO2013/081143, WO2007/114319, WO2009/041643, WO2014/145159, WO2012/016227, or WO2012/093704, each of which is incorporated herein by reference in their entirety.

The type of host cell of Disclosure A or B is not particularly limited, and the host cells include, for example, bacterial cells such as *E. coli*, as well as various animal cells. The host cells can be appropriately used as production systems for producing and expressing the antibodies. Both eukaryotic and prokaryotic cells can be used.

Eukaryotic cells for use as host cells include, for example, animal cells, plant cells, and fungal cells. Examples of animal cells include mammalian cells, for example, CHO (Puck et al., *J. Exp. Med.* 108:945-956 (1995)), COS, HEK293, 3T3, myeloma, BHK (baby hamster kidney), HeLa, and Vero; amphibian cells, for example, *Xenopus* oocyte (Valle et al., *Nature* 291:338-340 (1981)); and insect cells, for example, Sf9, Sf21, and Tn5. Recombinant vectors or others can be introduced into host cells, for example, using calcium phosphate methods, DEAE-dextran methods, methods using cationic liposome DOTAP (Boehringer-Mannheim), electroporation, and lipofection.

Plant cells that are known to serve as a protein production system include, for example, *Nicotiana tabacum*-derived cells and duckweed (*Lemna minor*)-derived cells. Calluses can be cultured from these cells to produce antibodies of Disclosure A or B. Fungal cell-based protein production systems include those using yeast cells, for example, cells of genus *Saccharomyces* such as *Saccharomyces cerevisiae* and *Schizosaccharomyces pombe*; and cells of filamentous fungi, for example, genus *Aspergillus* such as *Aspergillus*

*niger*. When prokaryotic cells are used, bacterial cell-based production systems can be used. Bacterial cell-based production systems include, for example, those using *Bacillus subtilis* as well as *E. coli*.

To produce an antibody of Disclosure A or B using host cells, the host cells are transformed with an expression vector containing a nucleic acid encoding an antibody of Disclosure A or B and cultured to express the nucleic acid. For example, when animal cells are used as a host, culture media may include, for example, DMEM, MEM, RPMI1640, and IMDM, which may be appropriately used in combination with serum supplements such as FBS or fetal calf serum (FCS). Alternatively, the cells may be cultured serum free.

On the other hand, animals or plants can be used for in vivo production systems for producing antibodies of Disclosure A or B, For example, a nucleic acid(s) encoding an antibody of Disclosure A or B can be introduced into such animals or plants to produce the antibody in vivo, and the antibody can then be collected from the animals or plants.

When animals are used as a host, production systems using mammals or insects are available. Preferred mammals include, but are not limited to, goats, pigs, sheep, mice, and bovines (Vicki Glaser, SPECTRUM Biotechnology Applications (1993)). Transgenic animals can also be used.

In one example, a nucleic acid encoding an antibody of Disclosure A or B is prepared as a fusion gene with a gene encoding a polypeptide that is specifically included in milk, such as goat β-casein. Then, goat embryos are injected with a polynucleotide fragment containing the fusion gene and transplanted into a female goat. The antibody of interest can be obtained from milk produced by the transgenic goats, which are born from goats that received the embryos, or from their offspring. Hormones can be appropriately administered to the transgenic goats to increase the volume of milk containing the antibody produced by the goats (Ebert et al., *Bio/Technology* 12:699-702 (1994)).

Insects for use in producing antibodies of Disclosure A or B include, for example, silkworms. When silkworms are used, baculoviruses whose viral genome is inserted with a polynucleotide encoding an antibody of interest is used to infect the silkworm. The antibody of interest can be obtained from the body fluids of the infected silkworms (Susumu et al., *Nature* 315:592-594 (1985)).

When plants are used for producing antibodies of Disclosure A or B, tobacco may be used. When tobacco is used, a recombinant vector resulting from insertion of a polynucleotide encoding an antibody of interest into a plant expression vector, for example, pMON 530 may be introduced into bacteria such as *Agrobacterium tumefaciens*. The resulting bacteria can be used to infect tobacco, for example, *Nicotiana tabacum* (Ma et al., *Eur. J. Immunol.* 24:131-138 (1994)) and the desired antibody is obtained from the leaves of the infected tobacco. Such modified bacteria can be also used to infect duckweed (*Lemna minor*), and the desired antibody is obtained from cloned cells of the infected duckweed (Cox et al. *Nat. Biotechnol.* 24(12):1591-1597 (2006)).

In order to secrete the antibody which is expressed in the host cells into the lumen of the endoplasmic reticulum, into the periplasmic space, or into the extracellular environment, suitable secretion signals may be incorporated into the polypeptide of interest. Such signals may be endogenous to the antibody of interest or may be a heterogeneous signal known in the art.

The antibody of Disclosure A or B produced as described above may be isolated from the inside or outside (such as media and milk) of host cells or a host, and purified to a substantially pure and homogenous antibody. The antibodies can be suitably isolated and purified, for example, by appropriately selecting and combining chromatographic columns, filtration, ultrafiltration, salting out, solvent precipitation, solvent extraction, distillation, immunoprecipitation, SDS-polyacrylamide gel electrophoresis, isoelectric focusing, dialysis, recrystallization, and others. Chromatography includes, for example, affinity chromatography, ion exchange chromatography, hydrophobic chromatography, gel filtration chromatography, reverse phase chromatography, and adsorption chromatography. Such chromatography can be performed, for example, by using liquid chromatography such as HPLC and FPLC. Columns for use in affinity chromatography may be Protein A column or Protein G column. Protein A column include, for example, Hyper D, POROS, Sepharose F.F. (Pharmacia).

The antibody can be modified or the peptide can be partially deleted by treating the antibody with appropriate protein modifying enzymes before or after antibody purification, as necessary. For such protein modifying enzymes, for example, trypsin, chymotrypsin, lysyl endopeptidase, protein kinases, and glucosidases can be used.

In an alternative embodiment, Disclosure A relates to methods for producing antibodies containing an antigen-binding domain whose antigen-binding activity changes according to the ion concentration condition, which may comprise culturing the host cells or raising the hosts and collecting antibodies from cultures of these cells, materials secreted from the hosts, or by other means known in the art.

In one embodiment, Disclosure A relates to a production method which comprises any one or more steps selected from the group consisting of: (a) selecting an antibody which can promote elimination of an antigen from plasma; (b) selecting an antibody with enhanced binding activity to an extracellular matrix; (c) selecting an antibody with enhanced FcγR-binding activity under a neutral pH condition; (d) selecting an antibody with enhanced FcγRIIb-binding activity under a neutral pH condition; (e) selecting an antibody with maintained or enhanced FcγRIIb-binding activity and decreased binding activity to one or more activating FcγR selected from the group consisting of FcγRIa, FcγRIb, FcγRIc, FcγRIIIa, FcγRIIIb, and FcγRIIa; (f) selecting an antibody with enhanced FcRn-binding activity under a neutral pH condition; (g) selecting an antibody with a pI; (h) confirming the pI of the collected antibody, and then selecting an antibody with an increased pI; and (i) selecting an antibody whose antigen-binding activity is changed or increased according to ion concentration conditions, as compared to a reference antibody.

Here, the reference antibody includes, but is not limited to, a native antibody (for example, a native Ig antibody, preferably a native IgG antibody) and an antibody before modification (an antibody prior to or during library construction, for example, an ion concentration-dependent antibody prior to increasing its pI, or an antibody with increased pI prior to conferring an ion concentration-dependent antigen-binding domain).

After producing antibodies of Disclosure A, the resulting antibodies may be assessed by antibody pharmacokinetic assay using plasma such as of mice, rats, rabbits, dogs, monkeys, humans, to select antibodies with enhanced antigen elimination from plasma as compared to the reference antibody.

Alternatively, after producing antibodies of Disclosure A, the resulting antibodies may be compared with a reference antibody in terms of the extracellular matrix-binding ability by electrochemiluminescence or others to select antibodies with increased binding to extracellular matrix.

Alternatively, after producing antibodies of Disclosure A, the resulting antibodies may be compared with a reference antibody in terms of the binding activity to various FcγRs under a neutral pH condition using BIACORE® or others to select antibodies with increased binding activity to various FcγRs under the neutral pH condition. In this case, the various FcγRs may be a type of FcγR of interest, for example, FcγRIIb. Similarly, it is also possible to select antibodies whose FcγRIIb-binding activity (under a neutral pH condition) has been maintained or increased and their binding activity to one or more activating FcγR selected from the group consisting of FcγRIa, FcγRIb, FcγRIc, FcγRIIIb and FcγRIIa, and so on, has been reduced. In such cases, FcγR can be FcγR.

Alternatively, after producing antibodies of Disclosure A, the resulting antibodies may be compared with a reference antibody in terms of the FcRn-binding activity under a neutral pH condition using BIACORE or other known techniques to select antibodies with increased FcRn-binding activity under the neutral pH condition. In this case, the FcRn can be human FcRn.

Alternatively, after producing antibodies of Disclosure A, the resulting antibodies may be evaluated for their pI by isoelectric focusing or others to select antibodies with increased pI as compared to the reference antibody. In this case, it is possible to select antibodies whose pI value has been increased, for example, by at least 0.01, 0.03, 0.05, 0.1, 0.2, 0.3, 0.4, or 0.5 or more, or at least 0.6, 0.7, 0.8, or 0.9 or more; or antibodies whose pI value has been increased by at least 1.0, 1.1, 1.2, 1.3, 1.4, or 1.5 or more, or at least 1.6, 1.7, 1.8, 1.9, 2.0, 2.1, 2.2, 2.3, 2.4, or 2.5 or more, or 3.0 or more.

Alternatively, after producing antibodies of Disclosure A, the resulting antibodies may be compared with a reference antibody in terms of binding activity to a desired antigen under low and high ion concentration conditions using BIACORE or others to select antibodies whose antigen-binding activity have been changed or increased according to the ion concentration condition. The ion concentration may be, for example, hydrogen ion concentration or metal ion concentration. When the ion concentration is a metal ion concentration, it can be, for example, calcium ion concentration. Whether the binding activity has been changed or increased may be assessed based on the presence of, for example: (a) an altered or enhanced antigen uptake by cells; (b) an altered or increased ability to bind to different antigen molecules multiple times; (c) an altered or enhanced reduction of antigen concentration in plasma; or (d) an altered plasma retention of the antibody. Alternatively, any two or more of these selection methods may be appropriately combined, if needed.

In an alternative embodiment, Disclosure A relates to methods for producing or screening for antibodies that contain an antigen-binding domain whose antigen-binding activity changes according to the ion concentration condition and whose pI has been increased by modifying at least one amino acid residue that can be exposed on the antibody surface ("ion concentration-dependent antibodies with increased pI"). The production methods can be performed, for example, by appropriately combining as needed, the related embodiments described within the scope of Disclosure A herein, for example, the embodiment of methods for producing or screening for antibodies with increased pI described above, as well as the embodiment of methods for producing or screening for calcium ion concentration-dependent antigen-binding domains or calcium ion concentration-dependent antibodies whose antigen-binding activity is higher under a high calcium ion concentration condition than under a low calcium ion concentration condition, or libraries thereof described above and/or the embodiment of methods for producing or screening for pH-dependent antigen-binding domains or pH-dependent antibodies whose antigen-binding activity is higher in a neutral pH condition than in an acidic pH condition, or libraries thereof described above.

In an alternative embodiment, Disclosure A provides be a method for producing or screening for an antibody containing an antigen-binding domain whose extracellular matrix-binding activity has been increased, wherein its antigen-binding activity changes according to the ion concentration condition and its pI has been increased by modifying at least one amino acid residue that can be exposed on the antibody surface ("ion concentration-dependent antibodies with increased pI"). Increase in pI of an ion concentration-dependent antibody may be contemplated in the method. Such method can be performed, for example, by appropriately combining as needed, related embodiments described within the scope of Disclosure A herein, for example, the embodiment of method for producing or screening for antibodies with an increased pI described above, as well as the embodiment of methods for producing or screening for calcium ion concentration-dependent antigen-binding domains or calcium ion concentration-dependent antibodies whose antigen-binding activity is higher under a high calcium ion concentration condition than under a low calcium ion concentration condition, or libraries thereof described above and/or the embodiment of methods for producing or screening for pH-dependent antigen-binding domains or pH-dependent antibodies whose antigen-binding activity is higher under a neutral pH condition than under an acidic pH condition, or libraries thereof described above. For example, the resulting antibodies may be compared with a reference antibody in terms of the extracellular matrix-binding ability by electrochemiluminescence or other known techniques to select antibodies with increased extracellular matrix binding.

Here, the reference antibody may include, but is not limited to, a native antibody (for example, a native Ig antibody, preferably a native IgG antibody) and an antibody before modification (an antibody prior to or during library construction, for example, an ion concentration-dependent antibody before its pI is increased or an antibody with increased pI before it is conferred with an ion concentration-dependent antigen-binding domain).

In an alternative embodiment, Disclosure A relates to a method for producing an antibody comprising an antigen-binding domain whose antigen-binding activity changes according to ion concentration conditions, wherein the method comprises modifying at least one amino acid residue that may be exposed on the surface of the antibody so as to increase the isoelectric point (pI). In some embodiments, the amino acid residue modification comprises a modification selected from the group consisting of: (a) substitution of a negatively charged amino acid residue with an uncharged amino acid residue; (b) substitution of a negatively charged amino acid residue with a positively charged amino acid residue; and (c) substitution of an uncharged amino acid residue with a positively charged amino acid residue. In some embodiments, at least one modified amino acid residue is substituted with histidine. In further embodiments, the antibody comprises a variable region and/or a constant region, and an amino acid residue is modified in the variable region and/or the constant region. In further embodiments, at least one amino acid residue modified according to the method is in a position in a CDR or FR selected from the group consisting of: (a) position 1, 3, 5, 8, 10, 12, 13, 15, 16, 18, 19, 23, 25, 26, 39, 41, 42, 43, 44, 46, 68, 71, 72, 73, 75, 76, 77, 81, 82, 82a, 82b, 83, 84, 85, 86, 105, 108, 110, and 112 in a FR of the heavy chain variable region; (b) position 31, 61, 62, 63, 64, 65, and 97 in a CDR of the heavy chain variable region; (c) position 1, 3, 7, 8, 9, 11, 12, 16, 17, 18, 20, 22, 37, 38, 39, 41, 42, 43, 45, 46, 49, 57, 60, 63, 65, 66, 68, 69, 70, 74, 76, 77, 79, 80, 81, 85, 100, 103, 105, 106, 107, and 108 in a FR of the light chain variable region; and (d) position 24, 25, 26, 27, 52, 53, 54, 55, and 56 in a CDR of the light chain variable region, according to Kabat numbering. In yet further embodiments, at least one amino acid residue modified according to the method is in a position in a CDR or FR selected from the group consisting of (a) position 8, 10, 12, 13, 15, 16, 18, 23, 39, 41, 43, 44, 77, 82, 82a, 82b, 83, 84, 85, and 105 in a FR of the heavy chain variable region; (b) position 31, 61, 62, 63, 64, 65, and 97 in a CDR of the heavy chain variable region; (c) position 16, 18, 37, 41, 42, 45, 65, 69, 74, 76, 77, 79, and 107 in a FR of the light chain variable region; and (d) position 24, 25, 26, 27, 52, 53, 54, 55, and 56 in a CDR of the light chain variable region. In some embodiments, the antigen is a soluble antigen. In some embodiments, the method further comprises comparing the KD of an antibody produced according to the method for its corresponding antigen in an acidic pH (e.g., pH 5.8) and a neutral pH (e.g., pH 7.4). In further embodiments, the method comprises selecting an antibody that has a KD (acidic pH range (e.g., pH 5.8))/KD (neutral pH range (e.g., pH 7.4)), for the antigen of 2 or higher. In some embodiments, the method further comprises comparing the antigen binding activity of an antibody produced according to the method under a high ion concentration (e.g., a hydrogen ion or calcium ion concentration) and a low ion concentration condition. In further embodiments the method further comprises selecting an antibody that has a higher antigen binding activity under a high ion concentration (e.g., 2-fold) than under a low ion concentration. In some embodiments, where the ion concentration is calcium ion concentration, the high calcium ion concentration may be selected between 100 μM and 10 mM, between 200 μM and 5 mM, between 400 μM and 3 mM, between 200 μM and 2 mM, or between 400 μM and 1 mM. A concentration selected between 500 μM and 2.5 mM, which is close to the plasma (blood) concentration of calcium ion in vivo, may be also preferred. In some embodiments, the low calcium ion concentration may be selected between 0.1 μM and 30 between 0.2 μM and 20 between 0.5 μM and 10 or between 1 μM and 5 or between 2 μM and 4 μM. A concentration selected between 1 μM and 5 which is close to the concentration of calcium ion in early endosomes in vivo, may be also preferred. In some embodiments, the lower limit of the KD (low calcium ion concentration condition)/KD (high calcium ion concentration condition) (e.g., KD (3 μM Ca)/KD (2 mM Ca)) value is 2 or more, 10 or more, or 40 or more, and the upper limit thereof is 400 or less, 1000 or less, or 10000 or less. In alternative some embodiments, the lower limit of the kd (low calcium ion concentration condition)/kd (high calcium ion concentration condition) (e.g., kd (3 μM Ca)/kd (2 mM Ca)) value is 2 or more, 5 or more, 10 or more, or 30 or more, and the upper limit thereof is 50 or less, 100 or less, or 200 or less. In some embodiments, where the ion concentration is hydrogen ion concentration, low hydrogen ion concentration (neutral pH range) may be selected from pH 6.7 to pH 10.0, from pH 6.7 to pH 9.5, from pH 7.0 to pH 9.0, or from pH 7.0 to pH 8.0. The low hydrogen ion concentration may be preferably pH 7.4 which is close to the in vivo pH in plasma (blood), but for the convenience of measurement, for example, pH 7.0 may be used. In some embodiments, high hydrogen ion concentration (acidic pH range) may be selected from pH 4.0 to pH 6.5, from pH 4.5 to pH 6.5, pH 5.0 to pH 6.5, or pH 5.5 to pH 6.5. The acidic pH range may be preferably pH 5.8 which is close to the in vivo hydrogen ion concentration in the early endosome, but for the convenience of measurement, for example, pH 6.0 may be used. In some embodiments, the lower limit of KD (acidic pH range)/KD (neutral pH range) (e.g., KD (pH 5.8)/KD (pH 7.4)) is 2 or more, 10 or more, or 40 or more, and the upper limit thereof is 400 or less, 1000 or less, or 10000 or less. In some embodiments, the method further comprises comparing the elimination of antigen from plasma after the administration of an antibody produced according to the method as compared to that when a reference antibody which differs only in that it does not include the modification(s) introduced according to the method, is administered. In further embodiments, the method further comprises selecting an antibody produced according to the method that promotes elimination of the antigen from plasma (e.g., 2-fold) as compared to an antibody that does not contain the modifications introduced according to the method. In some embodiments, the method further comprises comparing extracellular matrix-binding of the antibody produced according to the method as compared to the antibody which differs only in that it does not include the modification(s) introduced according to the method. In further embodiments the method further comprises selecting an antibody produced according to the method that has increased extracellular matrix-binding (e.g., 2-fold when bound to an antigen) as compared to an antibody which differs only in that it does not include the modification(s) introduced according to the method. In further embodiments, the antibodies produced according to the method (substantially) retain the antigen-binding activity when compared to the antibodies before modification or alteration of at least one amino acid residue to increase pI (native antibodies (for example, native Ig antibodies, preferably native IgG antibodies) or reference antibodies (e.g., antibodies before antibody modification, or prior to or during library construction)). In this case, "to (substantially) retain the antigen-binding activity" can mean to have an activity of at least 50% or more, preferably 60% or more, more preferably 70% or 75% or more, and still more preferably 80%, 85%, 90%, or 95% or more as compared to the binding activity of the antibodies before modification or alteration.

In an additional embodiment, Disclosure A relates to a method for producing an antibody comprising an antigen-binding domain whose antigen-binding activity changes according to ion concentration conditions, wherein the method comprises modifying at least one amino acid residue that may be exposed on the surface of a constant region of an antibody so as to increase the isoelectric point (pI). In some embodiments, the amino acid residue modification comprises a modification selected from the group consisting of: (a) substitution of a negatively charged amino acid residue with an uncharged amino acid residue; (b) substitution of a negatively charged amino acid residue with a positively charged amino acid residue; and (c) substitution of an uncharged amino acid residue with a positively charged amino acid residue. In some embodiments, at least one modified amino acid residue is substituted with histidine. In further embodiments, the antibody comprises a variable region and/or a constant region, and an amino acid residue is modified in the variable region and/or the constant region. In further embodiments, at least one amino acid residue modified according to the method is in a position in a constant region selected from the group consisting of position 196, 253, 254, 256, 258, 278, 280, 281, 282, 285, 286, 307, 309, 311, 315, 327, 330, 342, 343, 345, 356, 358, 359, 361, 362, 373, 382, 384, 385, 386, 387, 389, 399, 400, 401, 402, 413, 415, 418, 419, 421, 424, 430, 433, 434, and 443, according to EU numbering. In further embodiments, at least one amino acid residue modified according to the method is in a position in a constant region selected from the group consisting of position 254, 258, 281, 282, 285, 309, 311, 315, 327, 330, 342, 343, 345, 356, 358, 359, 361, 362, 384, 385, 386, 387, 389, 399, 400, 401, 402, 413, 418, 419, 421, 433, 434, and 443, according to EU numbering. In yet further embodiments, at least one amino acid residue modified according to the method is in a position in a constant region selected from the group consisting of position 282, 309, 311, 315, 342, 343, 384, 399, 401, 402, and 413, according to EU numbering. In some embodiments, the method further comprises comparing the antigen binding activity of an antibody produced according to the method under a high ion concentration (e.g., a hydrogen ion or calcium ion concentration) and a low ion concentration condition. In further embodiments the method further comprises selecting an antibody that has a higher antigen binding activity under a high ion concentration than under a low ion concentration. In some embodiments, the method comprises comparing the elimination of antigen from plasma after the administration of an antibody produced according to the method as compared to that when a reference antibody which differs only in that it does not include the modification(s) introduced according to the method, is administered. In further embodiments the method further comprises selecting an antibody produced according to the method that promotes elimination of the antigen from plasma (e.g., 2-fold) as compared to an antibody that does not contain the modifications introduced according to the method. In some embodiments, the method comprises comparing extracellular matrix-binding of the antibody produced according to the method as compared to the antibody which differs only in that it does not include the modification(s) introduced according to the method. In further embodiments the method further comprises selecting an antibody produced according to the method that has increased extracellular matrix-binding binding (e.g., 2-fold when bound to antigen) as compared to an antibody which differs only in that it does not include the modification(s) introduced according to the method. In some embodiments, the method comprises comparing the Fc gamma receptor (FcγR)-binding activity under neutral pH (e.g., pH 7.4) of an antibody produced according to the method with that of a reference antibody comprising a constant region of a native IgG. In further embodiments the method comprises selecting an antibody produced according to the method that has enhanced FcγR-binding activity under a neutral pH (e.g., pH 7.4) as compared to that of the reference antibody comprising a constant region of a native IgG. In some embodiments, the selected antibody produced according to the method has enhanced FcγRIIb binding activity under neutral pH. In some embodiments, the selected antibody produced according to the method has binding activity towards one or more activating FcγR, preferably selected from the group consisting of FcγRIa, FcγRIb, FcγRIc, FcγRIIIa, FcγRIIIb and FcγRIIa, and towards FcγRIIb, and optionally the FcγRIIb-binding activity is maintained or enhanced and the binding activity to the activating FcγRs is decreased, as compared to those of a reference antibody which differs only in that its constant region is that of a native IgG. In some embodiments, the method further comprises comparing FcRn-binding activity under a neutral pH condition of the antibody produced according to the method as compared to a reference antibody which differs only in that its constant region is that of a native IgG. In further embodiments, the method further comprises selecting an antibody produced according to the method that has increased FcRn-binding activity under a neutral pH condition as compared to that of a reference antibody which differs only in that its constant region is that of a native IgG (e.g., 2-fold). In some embodiments, the antibodies produced according to the method (substantially) retain the antigen-binding activity when compared to the antibodies before modification or alteration of at least one amino acid residue to increase pI (native antibodies (for example, native Ig antibodies, preferably native IgG antibodies) or reference antibodies (e.g., antibodies before antibody modification, or prior to or during library construction)). In this case, "to (substantially) retain the antigen-binding activity" can mean to have an activity of at least 50% or more, preferably 60% or more, more preferably 70% or 75% or more, and still more preferably 80%, 85%, 90%, or 95% or more as compared to the binding activity of the antibodies before modification or alteration.

In additional embodiments, the method comprises modifying at least one amino acid residue that may be exposed on the surface of a variable region and constant region of an antibody so as to increase the isoelectric point (pI). In further embodiments, at least one amino acid residue modified according to the method is in a position in a constant region disclosed above. In further embodiments at least one amino acid residue modified according to the method is in a position in a variable region disclosed above. In further embodiments, at least one amino acid residue modified according to the method is in a position in a constant region disclosed above and at least one amino acid residue modified according to the method is in a position in a variable region disclosed above. In some embodiments, the antigen is a soluble antigen. In some embodiments, the method further comprises comparing the KD of an antibody produced according to the method for its corresponding antigen in an acidic pH (e.g., pH 5.8) and a neutral pH (e.g., pH 7.4). In further embodiments, the method comprises selecting an antibody that has a KD (acidic pH range)/KD (neutral pH range), for the antigen of 2 or higher. In some embodiments, the method further comprises comparing the antigen binding activity of an antibody produced according to the method under a high ion concentration (e.g., a hydrogen ion or calcium ion concentration) condition and a low ion concentration condition. In further embodiments, the method further comprises selecting an antibody that has a higher antigen binding activity under a high ion concentration than under a low ion concentration. In some embodiments, where the ion concentration is calcium ion concentration, the high calcium ion concentration may be selected between 100 μM and 10 mM, between 200 μM and 5 mM, between 400 μM and 3 mM, between 200 μM and 2 mM, or between 400 μM and 1 mM. A concentration selected between 500 μM and 2.5 mM may be also preferred. In some embodiments, the low calcium ion concentration may be selected between 0.1 μM and 30 between 0.2 μM and 20 between 0.5 and 10 or between 1 μM and 5 or between 2 μM and 4 μM. A concentration selected between 1 μM and 5 μM may be also preferred. In some embodiments, the lower limit of the KD (low calcium ion concentration condition)/KD (high calcium ion concentration condition) (e.g., KD (3 μM Ca)/KD (2 mM Ca)) value is 2 or more, 10 or more, or 40 or more, and the upper limit thereof is 400 or less, 1000 or less, or 10000 or less. In alternative some embodiments, the lower limit of the kd (low calcium ion concentration condition)/kd (high calcium ion concentration condition) (e.g., kd (3 µM Ca)/kd (2 mM Ca)) value is 2 or more, 5 or more, 10 or more, or 30 or more, and the upper limit thereof is 50 or less, 100 or less, or 200 or less. In some embodiments, where the ion concentration is hydrogen ion concentration, low hydrogen ion concentration (neutral pH range) may be selected from pH 6.7 to pH 10.0, from pH 6.7 to pH 9.5, from pH 7.0 to pH 9.0, or from pH 7.0 to pH 8.0. The low hydrogen ion concentration may be preferably pH 7.4 which is close to the in vivo pH in plasma (blood), but for the convenience of measurement, for example, pH 7.0 may be used. In some embodiments, high hydrogen ion concentration (acidic pH range) may be selected from pH 4.0 to pH 6.5, from pH 4.5 to pH 6.5, pH 5.0 to pH 6.5, or pH 5.5 to pH 6.5. The acidic pH range may be pH 5.8 or pH 6.0, for example. In some embodiments, the lower limit of KD (acidic pH range)/KD (neutral pH range) (e.g., KD (pH 5.8)/KD (pH 7.4)) is 2 or more, 10 or more, or 40 or more, and the upper limit thereof is 400 or less, 1000 or less, or 10000 or less.

In some embodiments, the method further comprises comparing the elimination of antigen from plasma after the administration of an antibody produced according to the method as compared to that when a reference antibody which differs only in that it does not include the modification(s) introduced according to the method is administered. In further embodiments, the method further comprises selecting an antibody produced according to the method that promotes elimination of the antigen from plasma (e.g., 2-fold) as compared to an antibody that does not contain the modifications introduced according to the method. In some embodiments, the method further comprises comparing extracellular matrix-binding of the antibody produced according to the method as compared to the antibody which differs only in that it does not include the modification(s) introduced according to the method. In further embodiments, the method further comprises selecting an antibody produced according to the method that has increased extracellular matrix-binding binding (e.g., 5-fold when complexed with antigen) as compared to an antibody which differs only in that it does not include the modification(s) introduced according to the method. In some embodiments, the method further comprises comparing the Fc gamma receptor (FcγR)-binding activity under neutral pH (e.g., pH 7.4) of an antibody produced according to the method with that of a reference antibody comprising a constant region of a native IgG. In further embodiments, the method comprises selecting an antibody produced according to the method that has enhanced FcγR-binding activity under a neutral pH (e.g., pH 7.4) as compared to that of the reference antibody comprising a constant region of a native IgG. In some embodiments, the selected antibody produced according to the method has enhanced FcγRIIb binding activity under neutral pH. In some embodiments, the selected antibody produced according to the method has binding activity towards one or more activating FcγR, preferably selected from the group consisting of FcγRIa, FcγRIb, FcγRIc, FcγRIIIa, FcγRIIIb and FcγRIIa, and towards FcγRIIb, and optionally the FcγRIIb-binding activity is maintained or enhanced and the binding activity to the activating FcγRs is decreased, as compared to those of a reference antibody which differs only in that its constant region is that of a native IgG. In some embodiments, the method further comprises comparing FcRn-binding activity under a neutral pH condition of the antibody produced according to the method as compared to a reference antibody which differs only in that its constant region is that of a native IgG. In further embodiments, the method further comprises selecting an antibody produced according to the method that has increased FcRn-binding activity under a neutral pH condition (e.g., 2-fold) as compared to that of a reference antibody which differs only in that its constant region is that of a native IgG. In further embodiments, the antibodies produced according to the method (substantially) retain the antigen-binding activity when compared to the antibodies before modification or alteration of at least one amino acid residue to increase pI (native antibodies (for example, native Ig antibodies, preferably native IgG antibodies) or reference antibodies (e.g., antibodies before antibody modification, or prior to or during library construction)). In this case, "to (substantially) retain the antigen-binding activity" can mean to have an activity of at least 50% or more, preferably 60% or more, more preferably 70% or 75% or more, and still more preferably 80%, 85%, 90%, or 95% or more as compared to the binding activity of the antibodies before modification or alteration.

In an alternative embodiment, Disclosure A relates to an antibody obtained by the above-described method of Disclosure A for producing or screening antibodies.

In an alternative embodiment, Disclosure A relates to a composition or pharmaceutical composition comprising an antibody of Disclosure A described above. In one embodiment, the pharmaceutical composition of Disclosure A may be a pharmaceutical composition for accelerating antigen elimination from a biological fluid (preferably, plasma, etc.) of subjects and/or for increasing the extracellular matrix binding (when an antibody of Disclosure A is administered to (applied to) the subject (preferably, in vivo)). The pharmaceutical composition of Disclosure A may optionally contain a pharmaceutically acceptable carrier. Herein, pharmaceutical compositions may typically refer to agents for use in treatment, prevention, diagnosis, or examination of diseases.

The compositions or pharmaceutical compositions of Disclosure A can be suitably formulated. In some embodiments, they can be used parenterally, for example, in a form of a sterile solution or suspension for injection in water or any other pharmaceutically acceptable liquid. The compositions can be suitably formulated at a unit dose required for generally accepted pharmaceutical practice, by appropriately combining with pharmaceutically acceptable carriers or media. Such pharmaceutically acceptable carriers or media include, but are not limited to, sterile water, physiological saline, vegetable oils, emulsifiers, suspending agents, surfactants, stabilizers, flavoring agents, excipients, vehicles, preservatives, and binding agents. The amount of active ingredient in the compositions may be adjusted in such a way that the dose falls within an appropriate predetermined range.

In some embodiments, the compositions or pharmaceutical compositions of Disclosure A can be administered parenterally. The compositions or pharmaceutical compositions may be appropriately prepared as, for example, an injectable, transnasal, transpulmonary, or transdermal composition. The compositions or pharmaceutical compositions may be administered systemically or locally, for example, by intravenous injection, intramuscular injection, intraperitoneal injection, or subcutaneous injection.

In some embodiments, the disclosure provides antibodies whose pI is increased by modifying at least one amino acid residue that can be exposed on the surface (antibodies with increased pI); methods for producing these antibodies; or use of these antibodies to enhance antigen elimination from plasma (when the antibodies are administered to the subjects in vivo). It can be understood that the scope of Disclosure A described herein and the contents described in the counterpart Examples herein can be appropriately applied to such embodiments. In other embodiments, the disclosure provides antibodies whose pI is decreased by modifying at least one amino acid residue that can be exposed on the surface ("antibodies with decreased pI"); methods for producing these antibodies; or use of these antibodies to improve plasma retention (when the antibodies are administered to the subjects in vivo). The inventors have revealed that cellular internalization of an antibody can be enhanced by increasing its pI by introducing specific amino acid mutations into specific sites in the amino acid sequence of the constant region. Those of ordinary skill in the art can understand that antibody plasma retention can be prolonged as the pI has been reduced to suppress cellular internalization of the antibody by introducing amino acids with a different side-chain charge property into the sites described above. It can be understood that the scope of Disclosure A described herein and the contents described in the counterpart Examples herein can be appropriately applied to such embodiments.

In one embodiment, the disclosure provides a method for producing a modified antibody, whose half life in plasma is prolonged or reduced, as compared to that before the modification of the antibody, wherein the method comprises: (a) modifying a nucleic acid encoding the antibody before the modification to change the charge of at least one amino acid residue located at a position selected from the group consisting of position 196, 253, 254, 256, 257, 258, 278, 280, 281, 282, 285, 286, 306, 307, 308, 309, 311, 315, 327, 330, 342, 343, 345, 356, 358, 359, 361, 362, 373, 382, 384, 385, 386, 387, 388, 389, 399, 400, 401, 402, 413, 415, 418, 419, 421, 424, 430, 433, 434, and 443, according to EU numbering; (b) culturing a host cell to express the modified nucleic acid and to produce the antibody; and (c) collecting the produced antibody from the host cell culture.

An additional embodiment provides a method for prolonging or reducing the half-life of an antibody in plasma wherein the method comprises modifying at least one amino acid residue located at a position selected from the group consisting of position 196, 253, 254, 256, 257, 258, 278, 280, 281, 282, 285, 286, 306, 307, 308, 309, 311, 315, 327, 330, 342, 343, 345, 356, 358, 359, 361, 362, 373, 382, 384, 385, 386, 387, 388, 389, 399, 400, 401, 402, 413, 415, 418, 419, 421, 424, 430, 433, 434, and 443, according to EU numbering.

These methods may further comprise determining that the half life in plasma of the collected and/or modified antibody is prolonged or reduced, as compared to that before the modification of the antibody.

The change of charge may be achieved by amino acid substitution(s). In some embodiments, the substituted amino acid residue(s) may be selected from the group consisting of the amino acid residues of group (a) and (b) below, but is not limited thereto: (a) Glu (E) and Asp (D); and (b) Lys (K), Arg (R) and His (H).

In some embodiments, the antibody may be an Ig-type antibody such as an IgG antibody. In some embodiments, the antibody may be a chimeric antibody, humanized antibody, or human antibody. In some embodiments, the antibody may be a multispecific antibody such as a bispecific antibody.

Disclosure B

In non-limited embodiments, Disclosure B relates to Fc region variants, uses thereof, and production methods thereof.

Within the scope of Disclosures A and B described herein, an "Fc region variant" may refer, for example, to an Fc region modified from the Fc region of a native IgG antibody by modifying at least one amino acid with another amino acid, or may refer to an Fc region modified from such an Fc region variant by additionally modifying at least one amino acid with another amino acid. Herein, such Fc region variants include not only Fc regions that have been introduced with the amino acid modification but also Fc regions containing the same amino acid sequence as an aforementioned Fc region.

In an alternative embodiment, Disclosure B relates to Fc region variants containing an FcRn-binding domain which contains Ala at position 434; any one of Glu, Arg, Ser, and Lys at position 438; and any one of Glu, Asp, and Gln at position 440, according to EU numbering (within the scope of Disclosure B described herein, such an Fc region variant is also referred to as a "novel Fc region variant" for descriptive purposes).

In practice, Fc region variants of Disclosure B can be incorporated into virtually any antibody (e.g., multispecific antibodies such as bispecific antibodies) regardless of the type of the target antigen. For example, Anti-factor IXa/factor X bispecific antibodies can be produced using such Fc region variants as shown in Example 20 (e.g., F8M-F1847mv [F8M-F1847mv1 (SEQ ID NO:323) and F8M-F1847mv2 (SEQ ID NO:324) as the heavy chains and F8ML (SEQ ID NO:325) as the light chain]; F8M-F1868mv [F8M-F1868mv1 (SEQ ID NO:326) and F8M-F1868mv2 (SEQ ID NO:327) as the heavy chains and F8ML (SEQ ID NO:325) as the light chain]; and F8M-F1927mv [F8M-F1927mv1 (SEQ ID NO:328) and F8M-F1927mv2 (SEQ ID NO:329) as the heavy chains and F8ML (SEQ ID NO:325) as the light chain]).

As described above, WO2013/046704 reports that Fc region variants that have been introduced with a mutation to increase their FcRn binding under acidic conditions in combination with a specific mutation (a representative example is dual-residue mutation Q438R/S440E according to EU numbering) exhibit significantly reduced binding to rheumatoid factor. However, WO2013/046704 does not describe that the Fc region variants whose rheumatoid factor binding has been reduced due to the Q438R/S440E modification are superior in plasma retention as compared to antibodies with a native Fc region. Thus, there is a demand for safe and more advantageous Fc region variants that allow improved plasma retention, but do not bind to pre-existing ADA. The inventors disclose herein safe and more advantageous Fc region variants that allow improved plasma retention, but do not bind to anti-drug antibodies (pre-existing ADA, etc.). In particular, it is first disclosed herein that surprisingly, Fc region variants that contain combined mutations of amino acid residues, which are a substitution of Ala (A) for the amino acid at position 434 according to EU numbering and a specific dual-residue mutation (a representative example is Q438R/S440E), are preferable for prolonging antibody retention in plasma while maintaining a significantly reduced binding to rheumatoid factor.

Thus, the novel Fc region variants of Disclosure B disclosed herein provides an advantageous and surprising improvement over the Fc region variants described in WO2013/046704, which is incorporated herein by reference in their entirety.

In one embodiment, Disclosure B provides novel combinations of amino acid substitutions in the FcRn-binding domain, which increase the FcRn-binding activity of antibodies in an acidic pH range and in a neutral pH range, in particular, in an acidic pH range.

In one embodiment, an Fc region variant of Disclosure B contains Ala at position 434; any one of Glu, Arg, Ser, and Lys at position 438; and any one of Glu, Asp, and Gln at position 440, according to EU numbering; and more preferably contain Ala at position 434; either Arg or Lys at position 438; and either Glu or Asp at position 440, according to EU numbering. Preferably, the Fc region variant of Disclosure B additionally contains either Ile or Leu at position 428, and/or any one of Ile, Leu, Val, Thr, and Phe at position 436, according to EU numbering. More preferably the Fc region variant contains Leu at position 428, and/or either Val or Thr at position 436, according to EU numbering.

In one embodiment, the Fc region variant of Disclosure B can be an Fc region variant of a native Ig antibody, and more preferably the Fc region variant of a native IgG (IgG1, IgG2, IgG3, or IgG4 type) antibody. The native Fc region is partly described within the scope of Disclosures A and B, herein. More specifically, in Disclosure B, the native Fc region can refer to an unmodified or naturally-occurring Fc region, and preferably, an unmodified or naturally-occurring Fc region of a native Ig antibody whose Fc region amino acid residues remain unmodified. The antibody origin of the Fc region can be an Ig such as IgM or IgG, for example, human IgG1, IgG2, IgG3, or IgG4. In one embodiment, it may be human IgG1. Meanwhile, a (reference) antibody comprising a native Fc region can refer to an antibody comprising an unmodified or naturally-occurring Fc region.

Positions 428, 434, 438, and 440 are common to Fc regions of all native human IgG1, IgG2, IgG3, and IgG4 antibodies. However, at position 436 in the Fc region, native human IgG1, IgG2, and IgG4 antibodies share Tyr (Y) whereas native human IgG3 antibody has Phe (F). On the other hand, Stapleton et al. (*Nature Comm.* 599 (2011) reported that human IgG3 allotypes containing the amino acid substitution of R435H according to EU numbering have a plasma half-life in human comparable to that of IgG1. Thus, the inventors also conceived that plasma retention could be improved by increasing FcRn binding under an acidic condition by introducing the R435H amino acid substitution in combination with the amino acid substitution at position 436.

WO2013/046704 also specifically reported dual amino acid residue substitutions of Q438R/S440E, Q438R/S440D, Q438K/S440E, and Q438K/S440D according to EU numbering, which result in a significant reduction of the rheumatoid factor binding when combined with an amino acid substitution that can increase the FcRn binding under an acidic condition.

Thus, in a preferred embodiment, the FcRn-binding domain of an Fc region variant of Disclosure B may contain a combination of substituted amino acid positions selected from the group consisting of: (a) N434A/Q438R/S440E; (b) N434A/Q438R/S440D; (c) N434A/Q438K/S440E; (d) N434A/Q438K/S440D; (e) N434A/Y436T/Q438R/S440E; (f) N434A/Y436T/Q438R/S440D; (g) N434A/Y436T/Q438K/S440E; (h) N434A/Y436T/Q438K/S440D; (i) N434A/Y436V/Q438R/S440E; (j) N434A/Y436V/Q438R/S440D; (k) N434A/Y436V/Q438K/S440E; (l) N434A/Y436V/Q438K/S440D; (m) N434A/R435H/F436T/Q438R/S440E; (n) N434A/R435H/F436T/Q438R/S440D; (o) N434A/R435H/F436T/Q438K/S440E; (p) N434A/R435H/F436T/Q438K/S440D; (q) N434A/R435H/F436V/Q438R/S440E; (r) N434A/R435H/F436V/Q438R/S440D; (s) N434A/R435H/F436V/Q438K/S440E; (t) N434A/R435H/F436V/Q438K/S440D; (u) M428L/N434A/Q438R/S440E; (v) M428L/N434A/Q438R/S440D; (w) M428L/N434A/Q438K/S440E; (x) M428L/N434A/Q438K/S440D; (y) M428L/N434A/Y436T/Q438R/S440E; (z) M428L/N434A/Y436T/Q438R/S440D; (aa) M428L/N434A/Y436T/Q438K/S440E; (ab) M428L/N434A/Y436T/Q438K/S440D; (ac) M428L/N434A/Y436V/Q438R/S440E; (ad) M428L/N434A/Y436V/Q438R/S440D; (ae) M428L/N434A/Y436V/Q438K/S440E; (af) M428L/N434A/Y436V/Q438K/S440D; (ag) L235R/G236R/S239K/M428L/N434A/Y436T/Q438R/S440E; and (ah) L235R/G236R/A327G/A330S/P331S/M428L/N434A/Y436T/Q438R/S440E, according to EU numbering.

In a further preferred embodiment, the FcRn-binding domain of an Fc region variant of Disclosure B may contain a combination of substituted amino acids selected from the group consisting of: (a) N434A/Q438R/S440E; (b) N434A/Y436T/Q438R/S440E; (c) N434A/Y436V/Q438R/S440E; (d) M428L/N434A/Q438R/S440E; (e) M428L/N434A/Y436T/Q438R/S440E; (f) M428L/N434A/Y436V/Q438R/S440E; (g) L235R/G236R/S239K/M428L/N434A/Y436T/Q438R/S440E; and (h) L235R/G236R/A327G/A330S/P331S/M428L/N434A/Y436T/Q438R/S440E, according to EU numbering.

In one embodiment, it is preferable that the FcRn-binding activity of an Fc region variant of Disclosure B has been increased under an acidic pH condition as compared to the Fc region of a native IgG.

An increase in the FcRn-binding activity (binding affinity) of an FcRn-binding domain in a pH range may correspond to an increase of the measured FcRn-binding activity (binding affinity) when compared to the measured FcRn-binding activity (binding affinity) of a native FcRn-binding domain. In this case, KD (native Fc region)/KD (an Fc region variant of Disclosure B), which represents a difference in the binding activity (binding affinity), may be at least 1.5-fold, 2-fold, 3-fold, 4-fold, 5-fold, 10-fold, 15-fold, 20-fold, 50-fold, 70-fold, 80-fold, 100-fold, 500-fold, or 1000-fold. Such an increase may occur in an acidic pH range and/or in a neutral pH range; however, the increase in an acidic pH range can be preferred from the viewpoint of the action mechanism for Disclosure B.

In some embodiments, the FcRn-binding activity (for example, at pH 6.0 and 25° C.) of an Fc region variant of Disclosure B whose FcRn-binding activity has been increased in an acidic pH range is greater than that of the Fc region of a native IgG, for example, by 1.5-fold, 2-fold, 3-fold, 4-fold, 5-fold, 6-fold, 7-fold, 8-fold, 9-fold, 10-fold, 20-fold, 30-fold, 50-fold, 75-fold, 100-fold, 200-fold, 500-fold, 1000-fold or more. In some embodiments, the increased FcRn-binding activity of an Fc region variant in an acidic pH range may be greater than the FcRn-binding activity of the Fc region of a native IgG by at least 5-fold or at least 10-fold.

Manipulation of the FcRn-binding domain by introducing amino acid substitutions can occasionally reduce antibody stability (WO2007/092772). Proteins with poor stability tend to aggregate easily during storage, and the stability of pharmaceutical proteins is highly important in production of pharmaceutical agents. Thus, the decrease in stability caused by substitutions in the Fc region can lead to difficulty in developing stable antibody preparations (WO2007/092772).

The purity of pharmaceutical proteins in terms of monomer and high-molecular-weight species is also important in developing pharmaceutical agents. After purification with Protein A, wild-type IgG1 does not contain a significant amount of high-molecular-weight species, whereas manipulation of the FcRn-binding domain by introducing substitutions can produce a large amount of high-molecular-weight species. In this case, such high-molecular-weight species may have to be removed from the drug substance by purification steps.

Amino acid substitutions in antibodies can result in negative consequences, such as an increase in the immunogenicity of therapeutic antibodies which in turn can cause a cytokine storm and/or production of anti-drug antibodies (ADAs). The clinical utility and efficacy of therapeutic antibodies can be limited by ADAs, since they affect the efficacy and pharmacokinetics of therapeutic antibodies and sometimes lead to serious side effects. Many factors influence the immunogenicity of therapeutic antibodies, and the presence of effector T-cell epitopes is one of the factors. Likewise, the presence of pre-existing antibodies against a therapeutic antibody can also be problematic. An example of such pre-existing antibody is rheumatoid factor (RF), an auto-antibody (an antibody directed against a self-protein) against the Fc portion of an antibody (i.e., IgG). Rheumatoid factor is found in particular in patients with systemic lupus erythematosus (SLE) or rheumatoid arthritis. In arthritis patients, RF and IgG join to form immune complexes that contribute to the disease process. Recently, a humanized anti-CD4 IgG1 antibody with a Asn434His mutation has been reported to elicit significant rheumatoid factor binding (Zheng et al., *Clin. Pharmacol. Ther.* 89(2):283-290 (2011)). Detailed studies have confirmed that the Asn434His mutation in human IgG1 increases the binding of rheumatoid factor to the Fc region of the antibody as compared to the parental human IgG1.

RF is a polyclonal auto-antibody against human IgG. The RF epitope in the human IgG sequence varies among clones; however, the RF epitope seems to be located in the CH2/CH3 interface region as well as in the CH3 domain which may overlap with the FcRn-binding epitope. Thus, mutations to increase the FcRn-binding activity at a neutral pH may possibly increase the binding activity to specific RF clones as well.

In the context of Disclosure B, the term "anti-drug antibody" or "ADA" can refer to an endogenous antibody that has binding activity to an epitope located on a therapeutic antibody and thus can bind to the therapeutic antibody. The term "pre-existing anti-drug antibody" or "pre-existing ADA" can refer to an anti-drug antibody that is present and detectable in the blood of a patient prior to administration of the therapeutic antibody to the patient. In some embodiments, the pre-existing ADA is a human antibody. In further embodiments, the pre-existing ADA is rheumatoid factor.

The binding activity of an antibody Fc region (variant) against a pre-existing ADA can be, for example, represented by electrochemiluminescence (ECL) response at an acidic pH and/or at a neutral pH. The ECL assay is described, for example, in Moxness et al. (*Clin Chem.* 51:1983-1985 (2005)) and in Example 6. Assays can be performed, for example, under the conditions of MES buffer and 37° C. The antigen-binding activity of antibodies can be determined by, for example, BIACORE® analysis.

The binding activity to a pre-existing ADA can be assessed at any temperature from 10° C. to 50° C. In some embodiments, the binding activity (binding affinity) of a human Fc region to a human pre-existing ADA is determined at a temperature of 15° C. to 40° C., for example, such as between 20° C. to 25° C., or 25° C. In a further embodiment, the interaction between a human pre-existing ADA and a human Fc region is measured at pH 7.4 (or pH 7.0) and 25° C.

Within the scope of Disclosure B described herein, the binding activity to (pre-existing) ADA has been significantly increased or an equivalent expression may mean that the measured (pre-existing) ADA-binding activity (binding affinity) (i.e., KD) of an Fc region variant of Disclosure B or an antibody containing it has been increased, for example, by 0.55-fold, 0.6-fold, 0.7-fold, 0.8-fold, 0.9-fold, 1-fold, 1.1-fold, 1.2-fold, 1.3-fold, 1.4-fold, 1.5-fold, 1.6-fold, 1.7-fold, 1.8-fold, 1.9-fold, 2-fold, 2.1-fold, 2.2-fold, or 2.3-fold or more, as compared to the measured (pre-existing) ADA-binding activity (binding affinity) of a reference Fc region variant or a reference antibody containing the reference Fc region variant. Such an increase in the binding activity to a pre-existing ADA can be observed in an individual patient or in a patient group.

In one embodiment, as used in the context of Disclosure B, the term "patients" or "a patient" is not limited, and can include all humans with a disease who are under treatment with a therapeutic antibody. The patients may be humans affected with auto-immune disease, such as an arthritic disease or systemic erythematosus (SLE). The arthritic disease can include rheumatoid arthritis.

In one embodiment of Disclosure B, the binding activity to a pre-existing ADA is significantly increased in an individual patient may mean that the binding activity of an antibody comprising an Fc region variant (e.g., therapeutic antibody) to a pre-existing ADA measured in a patient has been increased by at least 10%, at least 20%, at least 30%, at least 40%, at least 50%, or at least 60% or more when compared to the binding activity of a reference antibody to the pre-existing ADA. Alternatively, this may mean that the ECL reaction for the antibody is preferably above 250, or at least 500, or at least 1000, or even at least 2000. Preferably, this increase may be an increase relative to a reference antibody whose ECL reaction is less than 500 or 250. Specifically, between the binding activity of a reference antibody to a pre-existing ADA and such binding activity of an antibody having an Fc region variant, the ECL reaction preferably ranges from less than 250 to at least 250, less than 250 to at least 500, less than 500 to 500 or more, less than 500 to 1000 or more, or less than 500 to at least 2000, without being limited thereto.

In one embodiment, the binding activity to a pre-existing ADA is increased can mean that in a group of patients, the measured proportion of patients who have an ECL reaction of at least 500 (preferably, at least 250) for an antibody comprising an Fc region variant with (a) increased binding activity to FcRn at an acidic pH and (b) increased binding activity to a pre-existing ADA at a neutral pH is elevated as compared to the proportion of patients who have an ECL reaction of at least 500 (preferably, at least 250 or more) for a reference antibody, for example, by at least 10%, at least 20%, at least 30%, at least 40%, at least 50% when compared to the proportion of patients who have an ECL reaction for a reference antibody.

In one embodiment of Disclosure B, the binding activity to a pre-existing ADA decreases can mean that the measured binding activity (i.e., KD or ECL reaction) of an antibody comprising an Fc region variant decreases as compared to that of a reference antibody. Such decrease can be observed in an individual patient or in a group of patients. The affinity of an antibody comprising an Fc region variant for a pre-existing ADA at a neutral pH significantly decreases in each patient can mean that the measured binding activity to a pre-existing ADA at a neutral pH measured in the patient is decreased as compared to the binding activity of a reference antibody to the pre-existing ADA measured at the neutral pH, for example, by at least 10%, at least 20%, at least 30%, at least 40%, or at least 50%.

Alternatively, the binding activity of an antibody containing an Fc region variant to a pre-existing ADA significantly decreases in an individual patient can mean that the ECL reaction for the antibody that used to be 500 or more (preferably, 1000 or more, or 2000 or more) is measured to be less than 500, preferably less than 250 as compared to the ECL reaction for a reference antibody, for example.

In a preferred embodiment, the Fc region variants of Disclosure B and antibodies comprising them have low binding activity to a pre-existing ADA at a neutral pH. Specifically, it is preferable that the binding activity of antibodies containing the Fc region variants of Disclosure B to a pre-existing ADA at a neutral pH is lower than or has not significantly been increased, as compared to the binding activity of a reference antibody containing the Fc region of a native IgG to the pre-existing ADA at a neutral pH (e.g., pH 7.4). The binding activity (binding affinity) to a pre-existing ADA is low or the affinity is at the baseline level can mean an ECL reaction of less than 500, or less than 250 in an individual patient, but is not limited thereto. The binding activity to a pre-existing ADA is low in a group of patients can mean that the ECL reaction is less than 500 in 90%, preferably 95%, and more preferably 98% of the patients in the group, for example.

It can be preferable to select Fc region variants of Disclosure B or antibodies containing them, whose binding activity to a (pre-existing) ADA in plasma at a neutral pH is not significantly increased, and whose FcRn-binding activity at a neutral pH and/or at an acidic pH is increased. Preferably the FcRn-binding activity at an acidic pH (e.g., pH 5.8) is increased. In one embodiment, the Fc region variants preferably do not have a significantly increased binding activity to ADA under a neutral pH condition (e.g., pH 7.4) as compared to the Fc region of a native IgG, and the ADA may be a pre-existing ADA, preferably rheumatoid factor (RF).

In one embodiment, it can be preferable that the Fc region variants of Disclosure B have an increased FcRn-binding activity under an acidic pH condition as compared to the Fc region of a native IgG, and as a result they exhibit reduced clearance (CL) in plasma, prolonged retention time in plasma, or prolonged half-life in plasma (t1/2). Their correlation is known in the art.

In one embodiment, it can be preferable that the Fc region variants of Disclosure B have an increased FcRn-binding activity under an acidic pH condition but do not have a significantly increased ADA-binding activity under a neutral pH condition as compared to the Fc region of a native IgG, and they exhibit reduced clearance (CL) in plasma, prolonged retention time in plasma, or prolonged half-life in plasma (t1/2). The ADA may be a pre-existing ADA, preferably rheumatoid factor (RF).

In one embodiment, the Fc region variants of Disclosure B are advantageous, since their plasma retention is improved as compared to a reference Fc region variant comprising a combination of amino acid substitutions N434Y/Y436V/Q438R/S440E according to EU numbering.

Examples 5 to 7 compare the plasma retention of two Fc region variants: Fc region variant F1718 (Fc region with mutations introduced at four sites: N434Y/Y436V/Q438R/S440E) described in WO2013/046704 and novel Fc region variant F1848m (introduced with mutations at four sites: N434A/Y436V/Q438R/S440E). Difference in amino acid mutation between the two Fc region variants is only at position 434 according to EU numbering, where the introduced amino acid mutation is Y (tyrosine) for F1718 and A (alanine) for F1848m. Nevertheless, when compared to a native IgG1, F1848m exhibited improved plasma retention while F1718 showed no such improvement in plasma retention (see Example (7-2)). Thus, the Fc region variants of Disclosure B can preferably have improved plasma retention as compared to reference Fc region variants containing the combination of amino acid substitutions N434Y/Y436V/Q438R/S440E. The experimental results described in Examples (5-2) and (7-3) herein demonstrate that among various Fc region variants, F1847m, F1886m, F1889m, and F1927m are further improved in plasma retention time than F1848m. Thus, those of ordinary skill in the art can appreciate that Fc region variants of Disclosure B comprising F1847m, F1886m, F1889m, or F1927m, as well as F1848m have improved plasma retention as compared to reference Fc region variants containing the substitutions N434Y/Y436V/Q438R/S440E.

The binding to FcγR or a complement protein can also have an unfavorable impact (for example, inappropriate platelet activation). Fc region variants that do not bind to effector receptors such as the FcγRIIa receptor can be safer and/or more advantageous. In some embodiments, the Fc region variants of Disclosure B have only a weak effector receptor-binding activity or do not bind to effector receptors. Examples of effector receptors include, activating FcγR, particularly FcγRI, FcγRII, and FcγRIII. FcγRI includes FcγRIa, FcγRIb, and FcγRIc, and subtypes thereof. FcγRII includes FcγRIIa (having two allotypes: R131 and H131) and FcγRIIb. FcγRIII includes FcγRIIIa (which has two allotypes: V158 and F158) and FcγRIIIb (which has two allotypes: FcγRIIIb-NA1 and FcγRIIIb-NA2). Antibodies that have only a weak effector receptor-binding activity or do not bind to the receptors include, for example, antibodies containing a silent Fc region and antibodies that do not have an Fc region (for example, Fab, F(ab)'$_2$, scFv, sc(Fv)$_2$, and diabodies).

Examples of Fc regions which have only a weak or no effector receptor-binding activity are described, for example, in Strohl et al. (*Curr. Op. Biotech.* 20(6):685-691 (2009)), and specifically include, for example, deglycosylated Fc regions (N297A and N297Q), and silent Fc regions resulting from manipulation of Fc regions to silence their effector functions (or to suppress immunity) (IgG1-L234A/L235A, IgG1-H268Q/A330S/P331S, IgG1-C226S/C229S, IgG1-C226S/C229S/E233P/L234V/L235A, IgG1-L234F/L235E/P331S, IgG2-V234A/G237A, IgG2-H268Q/V309L/A330S/A331S, IgG4-L235A/G237A/E318A, and IgG4-L236E). WO2008/092117 describes antibodies comprising a silent Fc region that contains a substitution of G236R/L328R, L235G/G236R, N325A/L328R, or N325L/L328R, according to EU numbering. WO2000/042072 describes antibodies comprising a silent Fc region that contains substitutions at one or more of positions EU233 (position 233 according to EU numbering), EU234, EU235, and EU237. WO2009/011941 describes antibodies comprising a silent Fc region that lacks the residues of EU231 to EU238. Davis et al. (*J. Rheum.* 34(11):2204-2210 (2007)) describes antibodies with a silent Fc region containing substitutions C220S/C226S/C229S/P238S. Shields et al. (*J. Biol. Chem.* 276(9):6591-6604 (2001)) describes antibodies comprising a silent Fc region containing substitution D265A. Modification of these amino acid residues may also be appropriately introduced into the Fc region variants of Disclosure B.

The expression "weak binding to effector receptors" can mean that the effector receptor-binding activity is, for example, 95% or less, preferably 90% or less, 85% or less, 80% or less, 75% or less, more preferably 70% or less, 65% or less, 60% or less, 55% or less, 50% or less, 45% or less, 40% or less, 35% or less, 30% or less, 25% or less, 20% or less, 15% or less, 10% or less, 9% or less, 8% or less, 7% or less, 6% or less, 5% or less, 4% or less, 3% or less, 2% or less, or 1% or less than that of a native IgG or an antibody containing a native IgG Fc region.

The "silent Fc region" is an Fc region variant containing one or more amino acid substitutions, insertions, additions, deletions, and others that reduce binding to effector receptors as compared to a native Fc region. Since the effector receptor-binding activity can be reduced considerably, such silent Fc regions may no longer bind to the effector receptors. The silent Fc regions may include, for example, Fc regions containing amino acid substitutions at one or more positions selected from the group consisting of: EU234, EU235, EU236, EU237, EU238, EU239, EU265, EU266, EU267, EU269, EU270, EU271, EU295, EU296, EU297, EU298, EU300, EU324, EU325, EU327, EU328, EU329, EU331, and EU332. Modification of these amino acid positions may also be appropriately introduced into the Fc region variants of Disclosure B.

In further embodiments, the silent Fc region has a substitution at one or more positions selected from the group consisting of: EU234, EU235, EU236, EU237, EU238, EU239, EU265, EU266, EU267, EU269, EU270, EU271, EU295, EU296, EU297, EU298, EU300, EU324, EU325, EU327, EU328, EU329, EU331, and EU332, and preferably the group consisting of: EU235, EU237, EU238, EU239, EU270, EU298, EU325, and EU329, wherein the substitution is with an amino acid residue selected from the listing below:

The amino acid at position EU234 is preferably substituted with an amino acid selected from the group consisting of Ala, Arg, Asn, Asp, Gln, Glu, Gly, His, Lys, Met, Phe, Pro, Ser, and Thr.

The amino acid at position EU235 is preferably substituted with an amino acid selected from the group consisting of Ala, Asn, Asp, Gln, Glu, Gly, His, Ile, Lys, Met, Pro, Ser, Thr, Val, and Arg.

The amino acid at position EU236 is preferably substituted with an amino acid selected from the group consisting of Arg, Asn, Gln, His, Leu, Lys, Met, Phe, Pro, and Tyr.

The amino acid at position EU237 is preferably substituted with an amino acid selected from the group consisting of Ala, Asn, Asp, Gln, Glu, His, Ile, Leu, Lys, Met, Pro, Ser, Thr, Val, Tyr, and Arg.

The amino acid at position EU238 is preferably substituted with an amino acid selected from the group consisting of Ala, Asn, Gln, Glu, Gly, His, Ile, Lys, Thr, Trp, and Arg.

The amino acid at position EU239 is preferably substituted with an amino acid selected from the group consisting of Gln, His, Lys, Phe, Pro, Trp, Tyr, and Arg.

The amino acid at position EU265 is preferably substituted with an amino acid selected from the group consisting of Ala, Arg, Asn, Gln, Gly, His, Ile, Leu, Lys, Met, Phe, Ser, Thr, Trp, Tyr, and Val.

The amino acid at position EU266 is preferably substituted with an amino acid selected from the group consisting of Ala, Arg, Asn, Asp, Gln, Glu, Gly, His, Lys, Phe, Pro, Ser, Thr, Trp, and Tyr.

The amino acid at position EU267 is preferably substituted with an amino acid selected from the group consisting of Arg, His, Lys, Phe, Pro, Trp, and Tyr.

The amino acid at position EU269 is preferably substituted with an amino acid selected from the group consisting of Ala, Arg, Asn, Gln, Gly, His, Ile, Leu, Lys, Met, Phe, Pro, Ser, Thr, Trp, Tyr, and Val.

The amino acid at position EU270 is preferably substituted with an amino acid selected from the group consisting of Ala, Arg, Asn, Gln, Gly, His, Ile, Leu, Lys, Met, Phe, Pro, Ser, Thr, Trp, Tyr, and Val.

The amino acid at position EU271 is preferably substituted with an amino acid selected from the group consisting of Arg, His, Phe, Ser, Thr, Trp, and Tyr.

The amino acid at position EU295 is preferably substituted with an amino acid selected from the group consisting of Arg, Asn, Asp, Gly, His, Phe, Ser, Trp, and Tyr.

The amino acid at position EU296 is preferably substituted with an amino acid selected from the group consisting of Arg, Gly, Lys, and Pro.

The amino acid at position EU297 is preferably substituted with Ala.

The amino acid at position EU298 is preferably substituted with an amino acid selected from the group consisting of Arg, Gly, Lys, Pro, Trp, and Tyr.

The amino acid at position EU300 is preferably substituted with an amino acid selected from the group consisting of Arg, Lys, and Pro.

The amino acid at position EU324 is preferably substituted with either Lys or Pro.

The amino acid at position EU325 is preferably substituted with an amino acid selected from the group consisting of Ala, Arg, Gly, His, Ile, Lys, Phe, Pro, Thr, Trp, Tyr, and Val.

The amino acid at position EU327 is preferably substituted with an amino acid selected from the group consisting of Arg, Gln, His, Ile, Leu, Lys, Met, Phe, Pro, Ser, Thr, Trp, Tyr, and Val.

The amino acid at position EU328 is preferably substituted with an amino acid selected from the group consisting of Arg, Asn, Gly, His, Lys, and Pro.

The amino acid at position EU329 is preferably substituted with an amino acid selected from the group consisting of Asn, Asp, Gln, Glu, Gly, His, Ile, Leu, Lys, Met, Phe, Ser, Thr, Trp, Tyr, Val, and Arg.

The amino acid at position EU330 is preferably substituted with either Pro or Ser.

The amino acid at position EU331 is preferably substituted with an amino acid selected from the group consisting of Arg, Gly, and Lys.

The amino acid at position EU332 is preferably substituted with an amino acid selected from the group consisting of Arg, Lys, and Pro.

The silent Fc region preferably may contain a substitution with either Lys or Arg at EU235, a substitution with either Lys or Arg at EU237, a substitution with either Lys or Arg at EU238, a substitution with either Lys or Arg at EU239, a substitution with Phe at EU270, a substitution with Gly at EU298, a substitution with Gly at EU325, or a substitution with either Lys or Arg at EU329. More preferably, the silent Fc region may contain a substitution with arginine at EU235 or a substitution with lysine at EU239. Even more preferably, the silent Fc region may contain L235R/S239K substitutions. Modification of these amino acid residues may also be appropriately introduced into the Fc region variants of Disclosure B.

In one embodiment, antibodies comprising an Fc region variant of Disclosure B have only a weak complement protein-binding activity or do not bind to complement proteins. In some embodiments, the complement protein is C1q. In some embodiments, the weak complement protein-binding activity refers to a complement protein-binding activity reduced by 10-fold or more, 50-fold or more, or 100-fold or more when compared to the complement protein-binding activity of a native IgG or an antibody containing a native IgG Fc region. The complement protein-binding activity of an Fc region can be reduced by amino acid modifications such as amino acid substitution, insertion, addition, or deletion.

In one embodiment, the Fc region variants of Disclosure B or antibodies comprising the Fc region variants can be assessed for their (human) FcRn-binding activity in a neutral pH range and/or in an acidic pH range in the same manner as described above.

In one embodiment, a method for modifying antibody constant regions to produce the Fc region variants of Disclosure B may be based, for example, on assessment of several constant region isotypes (IgG1, IgG2, IgG3, and IgG4) to select isotypes that have a reduced antigen-binding activity in an acidic pH range and/or have an increased dissociation rate in an acidic pH range. An alternative method may be based on introduction of amino acid substitutions into the amino acid sequence of a native IgG isotype to reduce the antigen-binding activity in an acidic pH range (e.g., pH 5.8) and/or to increase the dissociation rate in an acidic pH range. The hinge region sequence of an antibody constant region varies greatly across isotypes (IgG1, IgG2, IgG3, and IgG4), and differences in the hinge-region amino acid sequence can have a significant impact on the antigen-binding activity. Therefore, isotypes with reduced antigen-binding activity in an acidic pH range and/or increased dissociation rate in an acidic pH range can be selected by selecting suitable isotypes depending on the type of antigen or epitope. Furthermore, since differences in the hinge-region amino acid sequence can have a significant impact on the antigen-binding activity, amino acid substitutions in the amino acid sequences of native isotypes can be located in the hinge region.

In an alternative embodiment, Disclosure B provides a use of an antibody containing the above-described Fc region variant of Disclosure B to accelerate the release of the antibody that has been internalized into cells in an antigen-bound form to the outside of the cells in an antigen-free form. Herein, "release of an antibody that has been internalized into cells in an antigen-bound form to the outside of the cells in an antigen-free form" does not necessarily mean that the antibody that has been internalized into cells in an antigen-bound form is completely released to the outside of the cells in an antigen-free form. It is acceptable that the proportion of the antibody released in an antigen-free form to the outside of the cells is increased as compared to that before modification of its FcRn-binding domain (for example, before increasing the FcRn-binding activity of the antibody in an acidic pH range). It is preferable that the antibody released to the outside of the cells maintains its antigen-binding activity.

The "ability to eliminate antigen from plasma" or an equivalent term can refer to the ability to eliminate antigen from plasma when an antibody is administered or secreted in vivo. Thus, "the antibody's ability to eliminate antigen from plasma is increased" can mean that when an antibody is administered, for example, the rate of antigen elimination from plasma is increased as compared to that before modification of its FcRn-binding domain. The increase in the antibody's activity of antigen elimination from plasma can be assessed, for example, by administering a soluble antigen and the antibody in vivo, and measuring the concentration of the soluble antigen in plasma after administration. The soluble antigen may be an antibody-bound or antibody-free antigen, and their concentrations can be determined as "antibody-bound antigen concentration in plasma" and "antibody-free antigen concentration in plasma", respectively. The latter is synonymous with "free antigen concentration in plasma". The "total antigen concentration in plasma" can refer to the sum of antibody-bound antigen concentration and antibody-free antigen concentration.

In an alternative embodiment, Disclosure B provides a method for prolonging the plasma retention time of an antibody containing the Fc region variant of Disclosure B. Native human IgG can bind to FcRn derived from nonhuman animals. For example, since native human IgG can bind to mouse FcRn more strongly than to human FcRn (Ober et al., *Intl. Immunol.* 13(12):1551-1559 (2001)), the antibodies can be administered to mice for assessing the properties of the antibodies. Alternatively, for example, mice with their own FcRn gene has been disrupted but instead have and express the human FcRn gene as a transgene (Roopenian et al., *Meth. Mol. Biol.* 602:93-104 (2010)) are also suitable for assessing the antibodies.

Within the scope of Disclosures A and B described herein, the plasma concentration of free antigen not bound to the antibody or the ratio of free antigen concentration to the total antigen concentration can be determined (e.g., Ng et al., *Pharm. Res.* 23(1):95-103 (2006)). Alternatively, when an antigen exhibits a particular function in vivo, whether the antigen is bound to an antibody that neutralizes the antigen function (antagonistic molecule) can be assessed by testing whether the antigen function is neutralized. Whether the antigen function is neutralized can be evaluated by measuring a particular in vivo marker reflective of the antigen function. Whether an antigen is bound to an antibody that activates the antigen function (agonistic molecule) can be assessed by measuring a particular in vivo marker reflective of the antigen function.

There are no particular limitations on measurements such as determination of the free antigen concentration in plasma, determination of the ratio of the amount of free antigen in plasma to the amount of total antigen in plasma, and in vivo marker measurement; however, the measurements can be preferably carried out after a certain period of time following antibody administration. In the context of Disclosure B, "after a certain period of time following antibody administration" is not particularly limited, and the period can be appropriately determined by those of ordinary skill in the art depending on the properties of the administered antibody and others, and includes, for example, one day, three days, seven days, 14 days, or 28 days after antibody administration. Herein, the term "plasma antigen concentration" can refer to either "total antigen concentration in plasma" which is the sum of antibody-bound antigen concentration and antibody-free antigen concentration, or "free antigen concentration in plasma" which is antibody-free antigen concentration.

Molar ratio of antigen to antibody can be calculated using the formula: $C=A/B$, wherein value A is the molar concentration of antigen at each time point, value B is the molar concentration of antibody at each time point, and value C is the molar concentration of antigen per molar concentration of antibody (molar ratio of antigen/antibody) at each time point.

A smaller C value indicates a higher efficiency of antigen elimination per antibody, and a larger C value indicates a lower efficiency of antigen elimination per antibody.

In some aspects, when an antibody of Disclosure B is administered, the molar ratio of antigen/antibody is reduced by 2-fold, 5-fold, 10-fold, 20-fold, 50-fold, 100-fold, 200-fold, 500-fold, or 1,000-fold or more, as compared to when a reference antibody containing a native human IgG Fc region as a human FcRn-binding domain is administered.

The reduction of total antigen concentration in plasma or molar ratio of antigen/antibody can be assessed using methods know in the art, such as that described in Examples 6, 8, and 13 of WO2011/122011. More specifically, they can be assessed based on either an antigen-antibody co-injection model or a steady-state antigen infusion model using the human FcRn transgenic mouse line 32 or 276 (Jackson Laboratories, *Methods Mol. Biol.* 602:93-104 (2010)), when an antibody of interest in Disclosure B does not cross-react with the mouse counterpart antigen. When the antibody cross-reacts with the mouse counterpart, it can be assessed by simply injecting the antibody into the human FcRn transgenic mouse line 32 or 276 (Jackson Laboratories). In the co-injection model, a mixture of the antibody and antigen is administered to mice. In the steady-state antigen infusion model, an infusion pump filled with an antigen solution is implanted into mice to achieve a constant antigen concentration in plasma, and then the antibody is injected into the mice. All test antibodies are administered at the same dosage. The total antigen concentration in plasma, free antigen concentration in plasma, and antibody concentration in plasma can be measured at appropriate time points.

To assess the long-term effects of an antibody of Disclosure B, the total or free antigen concentration in plasma, or the molar ratio of antigen/antibody can be measured two days, four days, seven days, 14 days, 28 days, 56 days, or 84 days after administration. In other words, for assessing properties of the antibody, an antigen concentration in plasma in a long period of time can be determined by measuring the total or free antigen concentration in plasma, or the molar ratio of antigen/antibody two days, four days, seven days, 14 days, 28 days, 56 days, or 84 days after antibody administration. Whether the antigen concentration in plasma or the molar ratio of antigen/antibody is reduced with the antibody can be determined by assessing such reductions at one or more time points as described above.

To assess the short-term effects of an antibody of Disclosure B, the total or free antigen concentrations in plasma, or the molar ratio of antigen/antibody can be measured 15 minutes, one hour, two hours, four hours, eight hours, 12 hours, or 24 hours after administration. In other words, for assessing properties of the antibody, an antigen concentration in plasma in a short period of time can be determined by measuring the total or free antigen concentrations in plasma, or the molar ratio of antigen/antibody 15 minutes, one hour, two hours, four hours, eight hours, 12 hours, or 24 hours after administration. When the plasma retention in human is difficult to determine, it may be predicted based on the plasma retention in mice (for example, normal mice, human antigen-expressing transgenic mice, or human FcRn-expressing transgenic mice) or in monkeys (for example, cynomolgus monkeys).

In an alternative embodiment, Disclosure B relates to an antibody comprising the Fc region variant of Disclosure B described above. The various embodiments of the antibodies described within the scope of Disclosures A and B described herein can be applicable without opposing the common technical knowledge in the art and unless there are inconsistencies in the context.

In one embodiment, antibodies comprising an Fc region variant of Disclosure B are useful as therapeutic antibodies for treating human patients with auto-immune diseases, transplantation rejection (graft versus host disease), other inflammatory diseases, or allergy diseases, as described in WO2013/046704.

In one embodiment, antibodies comprising an Fc region variant of Disclosure B may have modified sugar chains. Antibodies with modified sugar chains can include, for example, antibodies with modified glycosylation (WO99/54342), antibodies that are deficient in fucose (WO00/61739, WO02/31140, WO2006/067847, WO2006/067913), and antibodies having sugar chains with bisecting GlcNAc (WO02/79255). In one embodiment, the antibodies may be deglycosylated. In some embodiments, the antibodies comprise, for example, mutations at the heavy-chain glycosylation site to inhibit glycosylation at such location as described in WO2005/03175. Such non-glycosylated antibodies can be prepared by modifying the heavy-chain glycosylation site, i.e., by introducing the N297Q or N297A substitution according to EU numbering, and expressing the proteins in appropriate host cells.

In an alternative embodiment, Disclosure B relates to a composition or a pharmaceutical composition comprising an antibody containing such an Fc region variant. The various embodiments of the compositions or pharmaceutical compositions described within the scope of Disclosures A and B herein can be applicable without opposing the common technological knowledge in the art and unless there are inconsistencies in the context. Such compositions can be used for enhancing the plasma retention (in subjects, when an antibody of the Disclosure B is administered (applied) to the subjects).

In an alternative embodiment, Disclosure B relates to nucleic acids encoding an Fc region variant or antibodies containing the Fc region variant. The various embodiments of the nucleic acids described within the scope of Disclosures A and B described herein can be applicable without opposing the common technical knowledge in the art and unless there are inconsistencies in the context. Alternatively, Disclosure B relates to vectors comprising the nucleic acids. The various embodiments thereof within the scope of Disclosures A and B described herein can be applicable without opposing the common technical knowledge in the art and unless there are inconsistencies in the context. Alternatively, Disclosure B relates to hosts or host cells comprising the vectors. The various embodiments thereof within the scope of Disclosures A and B described herein can be applicable without opposing the common technical knowledge in the art and unless there are inconsistencies in the context.

In an alternative embodiment, Disclosure B relates to methods for producing an Fc region variant comprising an FcRn-binding domain or an antibody comprising the Fc region variant, which comprise culturing the host cells described above, or growing the hosts described above and collecting the Fc region variant or antibody comprising the Fc region variant from the cell culture, materials secreted from the hosts. In this case, Disclosure B may include production methods optionally further comprising any one or more of: (a) selecting an Fc region variant with enhanced FcRn-binding activity under an acidic pH condition as compared to that of an Fc region of a native IgG; (b) selecting an Fc region variant whose binding activity to a (pre-existing) ADA is not significantly enhanced under a neutral pH condition as compared to that of an Fc region of a native IgG; (c) selecting an Fc region variant with increased plasma retention as compared to that of an Fc region of a native IgG; and (d) selecting an antibody comprising an Fc region variant that can promote elimination of an antigen from plasma as compared to a reference antibody comprising an Fc region of a native IgG.

From the perspective of assessing the plasma retention of an Fc region variant of Disclosure B, without limitations, it can be preferable that an antibody comprising the Fc region variant produced in Disclosure B and the "reference antibody comprising the Fc region of a native IgG" are identical to each other except for the Fc region to be compared. The FcRn can be human FcRn.

For example, after producing an antibody comprising an Fc region variant of Disclosure B, the antibody may be compared with the reference antibody comprising a native IgG Fc region in terms of the FcRn-binding activity under an acidic pH condition (e.g., pH 5.8) using BIACORE® or other known techniques, to select an Fc region variant or an antibody comprising the Fc region variant whose FcRn-binding activity has been increased under the acidic pH condition.

Alternatively, for example, after producing an antibody comprising an Fc region variant of Disclosure B, the antibody may be compared with a reference antibody comprising a native IgG Fc region in terms of the ADA-binding activity under a neutral pH condition by electrochemiluminescence (ECL) or known techniques, to select an Fc region variant or antibodies comprising the Fc region variant whose ADA-binding activity has not been significantly increased under the neutral pH condition.

Alternatively, for example, after producing an antibody comprising an Fc region variant of Disclosure B, the antibody may be compared with a reference antibody comprising a native IgG Fc region by conducting antibody pharmacokinetic tests using plasma, for example, from mice, rats, rabbits, dogs, monkeys, or humans, to select Fc region variants or antibodies comprising the Fc region variant which are demonstrated to have improved plasma retention in the subjects.

Alternatively, for example, after producing an antibody comprising an Fc region variant of Disclosure B, the antibody may be compared with a reference antibody comprising a native IgG Fc region by conducting antibody pharmacokinetic tests using plasma, for example, from mice, rats, rabbits, dogs, monkeys, or humans, to select Fc region variants or antibodies comprising the Fc region variant which have enhanced antigen elimination from plasma.

Alternatively, for example, the selection methods described above may be appropriately combined, if needed.

In one embodiment, Disclosure B relates to a method for producing an Fc region variant comprising an FcRn-binding domain or an antibody comprising the variant, wherein the method comprises substituting amino acids in a way such that the resulting Fc region variant or the antibody comprising the variant comprises Ala at position 434; Glu, Arg, Ser, or Lys at position 438; and Glu, Asp, or Gln at position 440, according to EU numbering. In an additional embodiment, such method comprises substituting the amino acids in a way such that the resulting Fc region variant or the antibody comprising the variant further comprises, Ile or Leu at position 428 and/or Ile, Leu, Val, Thr, or Phe at position 436, according to EU numbering. In a further embodiment, the amino acids are substituted in a way such that the resulting Fc region variant or the antibody comprising the variant produced according to the method further comprises Leu at position 428 and/or Val or Thr at position 436, according to EU numbering.

In one embodiment, Disclosure B relates to a method for producing an Fc region variant comprising an FcRn-binding domain or an antibody comprising the variant, wherein the method comprises substituting amino acids in a way such that the resulting Fc region variant or the antibody comprising the variant comprises Ala at position 434; Arg or Lys at position 438; and Glu or Asp at position 440, according to EU numbering. In an additional embodiment, such method comprises substituting the amino acids in a way such that the resulting Fc region variant or the antibody comprising the variant further comprises, Ile or Leu at position 428 and/or Ile, Leu, Val, Thr, or Phe at position 436, according to EU numbering. In a further embodiment, the amino acids are substituted in a way such that the resulting Fc region variant or the antibody comprising the variant produced according to the method further comprises Leu at position 428 and/or Val or Thr at position 436, according to EU numbering.

In one embodiment, such method comprises substituting all amino acids at positions 434, 438, and 440 with Ala; Glu, Arg, Ser, or Lys; and Glu, Asp, or Gln, respectively. In an additional embodiment, such method comprises substituting the amino acids in a way such that the resulting Fc region variant or the antibody comprising the variant further comprises, Ile or Leu at position 428 and/or Ile, Leu, Val, Thr, or Phe at position 436, according to EU numbering. In a further embodiment, the amino acids are substituted in a way such that the resulting Fc region variant or the antibody comprising the variant produced according to the method further comprises Leu at position 428 and/or Val or Thr at position 436, according to EU numbering.

In an alternative embodiment, Disclosure B relates to an Fc region variant or an antibody comprising the Fc region variant obtained by any of the production methods of Disclosure B described above.

In an alternative embodiment, Disclosure B provides methods for reducing the (pre-existing) ADA-binding activity of antibodies comprising an Fc region variant with increased FcRn-binding activity at an acidic pH; and methods for producing Fc region variants with increased FcRn-binding activity at an acidic pH (e.g., pH 5.8) and reduced pre-existing ADA-binding activity, which comprise: (a) providing an antibody comprising an Fc region (variant) whose FcRn-binding activity at an acidic pH has been increased as compared to a reference antibody; and (b) introducing into the Fc region, according to EU numbering, (i) an amino acid substitution with Ala at position 434; (ii) an amino acid substitution with any one of Glu, Arg, Ser, and Lys at position 438; and (iii) an amino acid substitution with any one of Glu, Asp, and Gln at position 440, (iv) optionally, an amino acid substitution with Ile or Leu at position 428; and/or (v) optionally, an amino acid substitution with any one of Ile, Leu, Val, Thr, and Phe at position 436.

In some embodiments, the Fc domain (variant) in step (a) is preferably a human IgG Fc domain (variant). Furthermore, to increase the FcRn-binding activity at an acidic pH and to decrease the (pre-existing) ADA-binding activity in a neutral pH range (e.g., pH 7.4), the Fc region (variant) is to contain a combination of substituted amino acids selected from the group consisting of: (a) N434A/Q438R/S440E; (b) N434A/Q438R/S440D; (c) N434A/Q438K/S440E; (d) N434A/Q438K/S440D; (e) N434A/Y436T/Q438R/S440E; (f) N434A/Y436T/Q438R/S440D; (g) N434A/Y436T/Q438K/S440E; (h) N434A/Y436T/Q438K/S440D; (i) N434A/Y436V/Q438R/S440E; (j) N434A/Y436V/Q438R/S440D; (k) N434A/Y436V/Q438K/S440E; (l) N434A/Y436V/Q438K/S440D; (m) N434A/R435H/F436T/Q438R/S440E; (n) N434A/R435H/F436T/Q438R/S440D; (o) N434A/R435H/F436T/Q438K/S440E; (p) N434A/R435H/F436T/Q438K/S440D; (q) N434A/R435H/F436V/Q438R/S440E; (r) N434A/R435H/F436V/Q438R/S440D;

(s) N434A/R435H/F436V/Q438K/S440E; (t) N434A/R435H/F436V/Q438K/S440D; (u) M428L/N434A/Q438R/S440E; (v) M428L/N434A/Q438R/S440D; (w) M428L/N434A/Q438K/S440E; (x) M428L/N434A/Q438K/S440D; (y) M428L/N434A/Y436T/Q438R/S440E; (z) M428L/N434A/Y436T/Q438R/S440D; (aa) M428L/N434A/Y436T/Q438K/S440E; (ab) M428L/N434A/Y436T/Q438K/S440D; (ac) M428L/N434A/Y436V/Q438R/S440E; (ad) M428L/N434A/Y436V/Q438R/S440D; (ae) M428L/N434A/Y436V/Q438K/S440E; (af) M428L/N434A/Y436V/Q438K/S440D; (ag) L235R/G236R/S239K/M428L/N434A/Y436T/Q438R/S440E; and (ah) L235R/G236R/A327G/A330S/P331 S/M428L/N434A/Y436T/Q438R/S440E.

The methods may optionally further comprise: (c) assessing whether the (pre-existing) ADA-binding activity of an antibody comprising a produced Fc region variant is reduced as compared to the binding activity of the reference antibody.

Alternatively, the methods may be used as a method for enhancing the release of an antibody that has been internalized into cells in an antigen-bound form to the outside of the cells in an antigen-free form, without significantly increasing the (pre-existing) ADA-binding activity of the antibody at a neutral pH.

Disclosure C

Disclosure C also relates to anti-IL-8 antibodies, nucleic acids encoding the antibodies, pharmaceutical compositions comprising the antibodies, methods for producing the antibodies, and uses of the antibodies in treating diseases related to IL-8, as described in detail hereinbelow. The meanings of the terms given hereinbelow apply throughout the description of Disclosure C herein, without being contrary to the common technical knowledge of those of ordinary skill in the art as well as embodiments known to those or ordinary skill in the art.

I. Definitions within the Scope of Disclosure C

Within the scope of Disclosure C described herein, "acidic pH" refers to pH that may be selected, for example, from pH 4.0 to pH 6.5. In one embodiment, acidic pH refers to, but is not limited to, pH 4.0, pH 4.1, pH 4.2, pH 4.3, pH 4.4, pH 4.5, pH 4.6, pH 4.7, pH 4.8, pH 4.9, pH 5.0, pH 5.1, pH 5.2, pH 5.3, pH 5.4, pH 5.5, pH 5.6, pH 5.7, pH 5.8, pH 5.9, pH 6.0, pH 6.1, pH 6.2, pH 6.3, pH 6.4, or pH 6.5. In a specific embodiment, the term acidic pH refers to the pH 5.8.

Within the scope of Disclosure C described herein, "neutral pH" refers to pH selected, for example, from 6.7 to pH 10.0. In one embodiment, neutral pH refers to, but is not limited to, pH 6.7, pH 6.8, pH 6.9, pH 7.0, pH 7.1, pH 7.2, pH 7.3, pH 7.4, pH 7.5, pH 7.6, pH 7.7, pH 7.8, pH 7.9, pH 8.0, pH 8.1, pH 8.2, pH 8.3, pH 8.4, pH 8.5, pH 8.6, pH 8.7, pH 8.8, pH 8.9, pH 9.0, pH 9.5, or pH 10.0. In a specific embodiment, the term neutral pH refers to the pH 7.4.

The term "IL-8", as used in Disclosure C, refers to any native IL-8 derived from any vertebrates, primates (e.g., humans, cynomolgus monkeys, rhesus monkeys) and other mammals (e.g., dogs and rabbits), unless otherwise indicated. The term "IL-8" encompasses full-length IL-8, unprocessed IL-8 as well as any form of IL-8 that results from processing in the cell. The term "IL-8" also encompasses derivatives of native IL-8, for example, splice variants or allelic variants. The amino acid sequence of an exemplary human IL-8 is shown in SEQ ID NO:66.

The terms "anti-IL-8 antibody" and "an antibody that binds to IL-8" refer to an antibody that is capable of binding IL-8 with sufficient affinity such that the antibody is useful as a diagnostic and/or therapeutic agent in targeting IL-8.

In one embodiment, the extent of binding of an anti-IL-8 antibody to an unrelated, non-IL-8 protein is, for example, less than about 10% of the binding of the antibody to IL-8.

"Affinity" within the scope of the description of Disclosure C herein generally refers to the strength of the sum total of noncovalent interactions between a single binding site of a molecule (e.g., an antibody) and its binding partner (e.g., an antigen). Unless indicated otherwise, as used within the scope of the description of Disclosure C herein, "binding affinity" refers to intrinsic binding affinity which reflects a 1:1 interaction between members of a binding pair (e.g., antibody and antigen). The affinity of a molecule X for its partner Y can generally be represented by the dissociation constant (KD). Binding affinity can be measured using methods known in the art, including those described within the scope of the description of Disclosure C herein.

In certain embodiments, an antibody that binds to IL-8 may have a dissociation constant (KD) of, for example, ≤1000 nM, ≤100 nM, ≤10 nM, ≤1 nM, ≤0.1 nM, ≤0.01 nM, or ≤0.001 nM (e.g., $10^{-8}$M or less, from $10^{-8}$ M to $10^{-13}$M, from $10^{-9}$M to $10^{-13}$ M).

The term "antibody" within the scope of the description of Disclosure C herein is used in the broadest sense and includes, but is not limited to, monoclonal antibodies, polyclonal antibodies, multispecific antibodies (e.g., bispecific antibodies), and antibody fragments so long as they exhibit the desired antigen-binding activity.

An "antibody that binds to the same epitope" as a reference antibody refers to an antibody that blocks binding of the reference antibody to its antigen by, for example, 50%, 60%, 70%, or 80% or more; and conversely, the reference antibody blocks binding of the antibody to its antigen by, for example, 50%, 60%, 70%, or 80% or more. Here, an exemplary competition assay can be used without being limited thereto.

A "chimeric antibody" refers to an antibody in which a portion of the heavy and/or light chain is derived from a particular source or species, while the remaining portion is derived from a different source or species.

A "humanized" antibody refers to a chimeric antibody comprising amino acid residues from non-human HVRs and amino acid residues from human FRs. In certain embodiments, a humanized antibody may comprise substantially at least one, and typically two, variable regions, in which all (or substantially all) of the HVRs (e.g., CDRs) correspond to those of a non-human antibody, and all (or substantially all) of the FRs correspond to those of a human antibody. A humanized antibody optionally may comprise at least a portion of an antibody constant region derived from a human antibody.

The term "monoclonal antibody" as used within the scope of the description of Disclosure C herein refers to an antibody obtained from a population of substantially homogeneous antibodies, i.e., the individual antibodies that constitute the population are identical and/or bind the same epitope, except for possible variant antibodies, for example, those containing naturally occurring mutations or arising during production of a monoclonal antibody preparation, which are generally present in minor amounts. In contrast to polyclonal antibody preparations which typically include different antibodies directed against different determinants (epitopes), each monoclonal antibody in a monoclonal antibody preparation is directed against a single determinant on an antigen. Thus, the modifier "monoclonal" indicates the characteristics of an antibody as being obtained from a substantially homogeneous population of antibodies, and is not to be construed as requiring production of the antibody by any specific method. For example, the monoclonal antibodies to be used in accordance with Disclosure C may be made by various techniques, including but not limited to the hybridoma method, recombinant DNA methods, phage-display methods, and methods utilizing transgenic animals comprising all or part of the human immunoglobulin loci, such methods and other exemplary methods for making monoclonal antibodies being described herein.

Within the scope of Disclosure C described herein, "native antibody" refers to immunoglobulin molecules with various naturally occurring structures. In an embodiment, a native IgG antibody, for example, is a heterotetrameric glycoprotein of about 150,000 daltons composed of two identical light chains and two identical heavy chains that are disulfide-bonded. In the order from N- to C-terminus, each heavy chain has a variable region (VH), which is also referred to as a variable heavy-chain domain or heavy-chain variable domain, followed by three constant domains (CH1, CH2, and CH3). Likewise, in the order from N- to C-terminus, each light chain has a variable region (VL), which is also referred to as a variable light-chain domain or light-chain variable domain, followed by a constant light-chain (CL) domain. An antibody light chain may be assigned to one of the two types, called kappa (K) and lambda ($\lambda$), based on the amino acid sequence of its constant domain. Such constant domains for use in the Disclosure C include those of any reported allotype (allele) or any subclass/isotype. The heavy-chain constant region includes, but is not limited to, the constant region of a native IgG antibody (IgG1, IgG2, IgG3, and IgG4). Known IgG1 alleles include, for example, IGHG1*01, IGHG1*02, IGHG1*03, IGHG1*04, and IGHG1*05 (see at imgt.org), and any of these can be used as a native human IgG1 sequence. The constant domain sequence may be derived from a single allele or subclass/isotype, or from multiple alleles or subclasses/isotypes. Specifically, such antibodies include, but are not limited to, an antibody whose CH1 is derived from IGHG1*01 and CH2 and CH3 are derived from IGHG1*02 and IGHG1*01, respectively.

"Effector functions" within the scope of the description of Disclosure C herein refers to biological activities attributable to the Fc region of an antibody, which may vary with the antibody isotype. Examples of antibody effector functions include: C1q binding and complement-dependent cytotoxicity; Fc receptor binding; antibody-dependent cell-mediated cytotoxicity (ADCC); phagocytosis; down regulation of cell surface receptors (e.g., B cell receptor); and B cell activation, but are not limited thereto.

The term "Fc region" within the scope of the description of Disclosure C herein is used to define a C-terminal region of an immunoglobulin heavy chain that contains at least a portion of the constant region. The term includes native Fc regions and variant Fc regions. The native Fc region indicates the Fc region of a native antibody.

In one embodiment, a human IgG heavy-chain Fc region extends from the amino acid residue of Cys226 or Pro230 to the carboxyl terminus of the heavy chain. However, the C-terminal lysine (Lys447) or glycine-lysine (residues 446-447) of the Fc region may or may not be present. Unless otherwise specified within the scope of the description of Disclosure C herein, the numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

"Framework" or "FR" within the scope of the description of Disclosure C herein refers to variable domain residues other than hypervariable region (HVR) residues. The FR of a variable domain generally consists of four FR domains: FR1, FR2, FR3, and FR4. Accordingly, the HVR and FR sequences generally appear in the following sequence: FR1-H1(L1)-FR2-H2(L2)-FR3-H3(L3)-FR4 in VH (or VL).

A "human consensus framework" within the scope of the description of Disclosure C herein is a framework that represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup according to Kabat et al., Sequences of proteins of Immunological Interest, 5th Ed. Public Health Service, National Institutes of Health, Bethesda, Md. (1991).

In one embodiment, the subgroup for the VL is subgroup id as in Kabat et al., supra. In one embodiment, the subgroup for the VH is subgroup III as in Kabat et al., supra.

An "acceptor human framework" for purposes within the scope of the description of Disclosure C herein is a framework comprising the amino acid sequence of a VL or VH framework derived from a human immunoglobulin framework or a human consensus framework. An acceptor human framework "derived from" a human immunoglobulin framework or a human consensus framework may comprise the same amino acid sequence thereof, or it may contain existing amino acid sequence substitutions. In some embodiments, the number of existing amino acid substitutions are 10 or less, 9 or less, 8 or less, 7 or less, 6 or less, 5 or less, 4 or less, 3 or less, or 2 or less. In one embodiment, the VL acceptor human framework is identical to the VL human immunoglobulin framework sequence or human consensus framework sequence.

The term "variable region" or "variable domain" within the scope of the description of Disclosure C herein refers to the domain of an antibody heavy or light chain involved in binding of the antibody to an antigen. The variable regions of the heavy chain and light chain (VH and VL, respectively) of a native antibody generally have similar structures, with each domain comprising four conserved framework regions (FRs) and three hypervariable regions (HVRs). (See, Kindt et al., Kuby Immunology, $6^{th}$ ed., W.H. Freeman and Co., page 91 (2007).) A single VH or VL domain is sufficient to confer antigen-binding specificity, but is not limited thereto. Furthermore, antibodies that bind to a particular antigen may be isolated using a VH or VL domain from an antibody that binds the antigen to screen a library of complementary VL or VH domains, respectively. See, e.g., Portolano et al., *J. Immunol.* 150:880-887 (1993); Clarkson et al., *Nature* 352: 624-628 (1991).

The term "hypervariable region" or "HVR" as used within the scope of the description of Disclosure C herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six hypervariable regions: three in the VH (H1, H2, H3), and three in the VL (L1, L2, L3).

Without being limited thereto, exemplary HVRs herein include: (a) hypervariable loops in which amino acid residues are 26-32 (L1), 50-52 (L2), 91-96 (L3), 26-32 (H1), 53-55 (H2), and 96-101 (H3) (Chothia and Lesk, *J. Mol. Biol.* 196:901-917 (1987)); (b) CDRs in which amino acid residues are 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service, National Institutes of Health, Bethesda, Md. (1991)); (c) antigen contacts in which amino acid residues are 27c-36 (L1), 46-55 (L2), 89-96 (L3), 30-35b (H1), 47-58 (H2), and 93-101 (H3) (MacCallum et al., *J. Mol. Biol.* 262:732-745 (1996)); and (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise instructed, HVRs and other residues in variable regions (e.g., FR residues) are numbered as in Kabat et al., supra.

An "individual" within the scope of the description of Disclosure C herein is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the "individual" is a human.

An "isolated" antibody within the scope of the description of Disclosure C herein is one which has been separated from a component of its natural environment. In some embodiments, an antibody is purified to be greater than 95% or 99% in purity as determined, for example, electrophoretically (e.g., SDS-PAGE, isoelectric focusing electrophoresis (IEF), capillary electrophoresis) or chromatographically (e.g., ion exchange or reverse phase HPLC). For review of methods for assessment of antibody purity, see, e.g., Flatman et al., *J. Chromatogr. B* 848:79-87 (2007).

An "isolated" nucleic acid within the scope of the description of Disclosure C herein refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an anti-IL-8 antibody" within the scope of the description of Disclosure C herein refers to one or more nucleic acid molecules encoding anti-IL-8 antibody heavy and light chains (or fragments thereof), including such nucleic acid(s) in a single vector or separate vectors, nucleic acid(s) present at one or more locations in a host cell.

Within the scope of the description of Disclosure C herein, the terms "host cell," "host cell line," and "host cell culture" are used interchangeably and refer to cells into which an exogenous nucleic acid has been introduced, including the progeny of such cells. Host cells include "transformants" and "transformed cells," which include the primary transformed cell and progeny derived therefrom without regard to the number of passages. A progeny may not be completely identical in its nucleic acid content to a parent cell, but may contain mutations. A mutant progeny that has the same function or biological activity as that screened or selected in the originally transformed cell are included herein.

The term "vector", as used within the scope of the description of Disclosure C herein, refers to a nucleic acid molecule capable of propagating another nucleic acid to which it is linked. The term includes vectors in a self-replicating nucleic acid structure as well as vectors introduced into a host cell and become incorporated into its genome. Certain vectors are capable of directing the expression of nucleic acids to which they are operatively linked. Such vectors are referred to herein as "expression vectors."

Within the scope of the description of Disclosure C herein, the term "package insert" is used to refer to instructions customarily included in commercial packages of therapeutic products, that contain information about the indications, usage, dosage, administration, combination therapy, contraindications and/or warnings concerning the use of such therapeutic products.

Within the scope of the description of Disclosure C herein, "percent (%) amino acid sequence identity" with respect to a reference polypeptide sequence is defined as the percentage of amino acid residues in a candidate sequence that are identical to the amino acid residues in the reference polypeptide sequence after sequence alignment, by introducing gaps if necessary and not considering any conservative substitutions as part of the sequence identity, in order to achieve the maximum percent sequence identity. Alignment for purposes of determining percent amino acid sequence identity can be achieved in various ways within the scope of the ability of those of ordinary skill in the art, for instance, by using publicly available computer software such as BLAST, BLAST-2, ALIGN, Megalign (DNASTAR) software, or GENETYX® (Genetyx Co., Ltd.). Those of ordinary skill in the art can determine appropriate parameters for aligning sequences, including any algorithms needed to achieve maximal alignment over the full length of the sequences being compared. For purposes herein, however, values of the % amino acid sequence identity are generated, for example, using the sequence comparison computer program ALIGN-2. The ALIGN-2 was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX (registered trademark) operating system, including digital UNIX (registered trademark) V4.0D. All sequence comparison parameters are set by the ALIGN-2 program and do not vary.

In situations where ALIGN-2 is employed for amino acid sequence comparisons, the % amino acid sequence identity of a given amino acid sequence A to a given amino acid sequence B (which can alternatively be phrased as a given amino acid sequence A that has or comprises a certain % amino acid sequence identity to a given amino acid sequence B) is calculated as follows: 100 times the fraction X/Y, where X is the number of amino acid residues scored as identical matches in the program alignment of A and B by the sequence alignment program ALIGN-2, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % values of amino acid sequence identity are obtained using the ALIGN-2 computer program as demonstrated under the scope of the description of Disclosure C herein.

Within the scope of Disclosure C described herein, a "pharmaceutical composition" generally refers to an agent for treating, preventing, examining, or diagnosing diseases. A "pharmaceutically acceptable carrier" refers to an ingredient in a pharmaceutical composition, other than an active ingredient, which is nontoxic to a subject. Such pharmaceutically acceptable carriers include, but are not limited to, buffers, excipients, stabilizers, and preservatives.

As used within the scope of Disclosure C described herein, "treatment" (and grammatical variations thereof such as "treat" or "treating") refers to a clinical intervention in an attempt to alter the natural course of the individual being treated. Such a clinical intervention can be performed either for prophylaxis or during the course of clinical pathology. Desirable effects of treatment include, but are not limited to, prevention of the occurrence or recurrence of a disease, alleviation of symptoms, diminishment of any direct or indirect pathological consequences of the disease, prevention of metastasis, decrease of the rate of disease progression, amelioration or palliation of the disease state, and remission or improvement of prognosis. In one embodiment, an antibody of Disclosure C can be used to slow down the progression of a disease or disorder.

Within the scope of Disclosure C described herein, an "effective amount" of an antibody or pharmaceutical composition refers to an amount that is effective when used at doses and for periods of time necessary to achieve the desired therapeutic or prophylactic result.

II. Compositions and Methods

In one embodiment, Disclosure C is based on the applicability of anti-IL-8 antibodies that have pH-dependent affinity for IL-8 as pharmaceutical compositions. The antibodies of Disclosure C are useful, for example, in diagnosing or treating diseases where IL-8 is present in an excessive amount.

A. Exemplary Anti-IL-8 Antibodies

In one embodiment, Disclosure C provides an anti-IL-8 antibody having pH-dependent affinity for IL-8.

In one embodiment, Disclosure C provides an anti-IL-8 antibody having pH-dependent affinity for IL-8, which comprises a sequence with at least one, two, three, four, five, six, seven, or eight amino acid substitution(s) within the amino acid sequences of: (a) HVR-H1 which comprises the amino acid sequence of SEQ ID NO:67; (b) HVR-H2 which comprises the amino acid sequence of SEQ ID NO:68; (c) HVR-H3 which comprises the amino acid sequence of SEQ ID NO:69; (d) HVR-L1 which comprises the amino acid sequence of SEQ ID NO:70; (e) HVR-L2 which comprises the amino acid sequence of SEQ ID NO:71; and (f) HVR-L3 which comprises the amino acid sequence of SEQ ID NO:72.

In another embodiment, Disclosure C provides an anti-IL-8 antibody having pH-dependent affinity for IL-8, which comprises at least one amino acid substitution(s) in at least one of the amino acid sequences of: (a) HVR-H1 which comprises the amino acid sequence of SEQ ID NO:67; (b) HVR-H2 which comprises the amino acid sequence of SEQ ID NO:68; (c) HVR-H3 which comprises the amino acid sequence of SEQ ID NO:69; (d) HVR-L1 which comprises the amino acid sequence of SEQ ID NO:70; (e) HVR-L2 which comprises the amino acid sequence of SEQ ID NO:71; and (f) HVR-L3 which comprises the amino acid sequence of SEQ ID NO:72.

Unless otherwise specified, the amino acids may be substituted with any other amino acid. In one embodiment, an anti-IL-8 antibody of Disclosure C comprises one or more amino acid substitution(s) at position(s) selected from the group consisting of: aspartic acid at position 1 in the sequence of SEQ ID NO:67; (b) tyrosine at position 2 in the sequence of SEQ ID NO:67; (c) tyrosine at position 3 in the sequence of SEQ ID NO:67; (d) leucine at position 4 in the sequence of SEQ ID NO:67; (e) serine at position 5 in the sequence of SEQ ID NO:67; (f) leucine at position 1 in the sequence of SEQ ID NO:68; (g) isoleucine at position 2 in the sequence of SEQ ID NO:68; (h) arginine at position 3 in the sequence of SEQ ID NO:68; (i) asparagine at position 4 in the sequence of SEQ ID NO:68; (j) lysine at position 5 in the sequence of SEQ ID NO:68; (k) alanine at position 6 in the sequence of SEQ ID NO:68; (l) asparagine at position 7 in the sequence of SEQ ID NO:68; (m) glycine at position 8 in the sequence of SEQ ID NO:68; (n) tyrosine at position 9 in the sequence of SEQ ID NO:68; (o) threonine at position 10 in the sequence of SEQ ID NO:68; (p) arginine at position 11 in the sequence of SEQ ID NO:68; (q) glutamic acid at position 12 in the sequence of SEQ ID NO:68; (r) tyrosine at position 13 in the sequence of SEQ ID NO:68; (s) serine at position 14 in the sequence of SEQ ID NO:68; (t) alanine at position 15 in the sequence of SEQ ID NO:68; (u) serine at position 16 in the sequence of SEQ ID NO:68; (v) valine at position 17 in the sequence of SEQ ID NO:68; (w) lysine at position 18 in the sequence of SEQ ID NO:68; (x) glycine at position 19 in the sequence of SEQ ID NO:68; (y) glutamic acid at position 1 in the sequence of SEQ ID NO:69; (z) asparagine at position 2 in the sequence of SEQ ID NO:69; (aa) tyrosine at position 3 in the sequence of SEQ ID NO:69; (ab) arginine at position 4 in the sequence of SEQ ID NO:69; (ac) tyrosine at position 5 in the sequence of SEQ ID NO:69; (ad) aspartic acid at position 6 in the sequence of SEQ ID NO:69; (ae) valine at position 7 in the sequence of SEQ ID NO:69; (af) glutamic acid at position 8 in the sequence of SEQ ID NO:69; (ag) leucine at position 9 in the sequence of SEQ ID NO:69; (ah) alanine at position 10 in the sequence of SEQ ID NO:69; (ai) tyrosine at position 11 in the sequence of SEQ ID NO:69; (aj) arginine at position 1 in the sequence of SEQ ID NO:70; (ak) alanine at position 2 in the sequence of SEQ ID NO:70; (al) serine at position 3 in the sequence of SEQ ID NO:70; (am) glutamic acid at position 4 in the sequence of SEQ ID NO:70; (an) isoleucine at position 5 in the sequence of SEQ ID NO:70; (ao) isoleucine at position 6 in the sequence of SEQ ID NO:70; (ap) tyrosine at position 7 in the sequence of SEQ ID NO:70; (aq) serine at position 8 in the sequence of SEQ ID NO:70; (ar) tyrosine at position 9 in the sequence of SEQ ID NO:70; (as) leucine at position 10 in the sequence of SEQ ID NO:70; (at) alanine at position 11 in the sequence of SEQ ID NO:70; (au) asparagine at position 1 in the sequence of SEQ ID NO:71; (av) alanine at position 2 in the sequence of SEQ ID NO:71; (aw) lysine at position 3 in the sequence of SEQ ID NO:71; (ax) threonine at position 4 in the sequence of SEQ ID NO:71; (ay) leucine at position 5 in the sequence of SEQ ID NO:71; (az) alanine at position 6 in the sequence of SEQ ID NO:71; (ba) aspartic acid at position 7 in the sequence of SEQ ID NO:71; (bb) glutamine at position 1 in the sequence of SEQ ID NO:72; (bc) histidine at position 2 in the sequence of SEQ ID NO:72; (bd) histidine at position 3 in the sequence of SEQ ID NO:72; (be) phenylalanine at position 4 in the sequence of SEQ ID NO:72; (bf) glycine at position 5 in the sequence of SEQ ID NO:72; (bg) phenylalanine of position 6 in the sequence of SEQ ID NO:72; (bh) proline at position 7 in the sequence of SEQ ID NO:72; (bi) arginine at position 8 in the sequence of SEQ ID NO:72; and (bj) threonine at position 9 in the sequence of SEQ ID NO:72.

In one embodiment, an anti-IL-8 antibody of Disclosure C comprises one or more amino acid substitution(s) at position(s) selected from the group consisting of: (a) alanine at position 6 in the sequence of SEQ ID NO:68; (b) glycine at position 8 in the sequence of SEQ ID NO:68; (c) tyrosine at position 9 in the sequence of SEQ ID NO:68; (d) arginine at position 11 in the sequence of SEQ ID NO:68; and (e) tyrosine at position 3 in the sequence of SEQ ID NO:69.

In one embodiment, an anti-IL-8 antibody of Disclosure C comprises combination(s) of amino acid substitutions at positions selected from the group consisting of: (a) alanine at position 6 in the sequence of SEQ ID NO:68; (b) glycine at position 8 in the sequence of SEQ ID NO:68; (c) tyrosine at position 9 in the sequence of SEQ ID NO:68; (d) arginine at position 11 in the sequence of SEQ ID NO:68; and (e) tyrosine at position 3 in the sequence of SEQ ID NO:69.

In one embodiment, an anti-IL-8 antibody of Disclosure C comprises amino acid substitutions at the following positions: (a) tyrosine at position 9 in the sequence of SEQ ID NO:68; (b) arginine at position 11 in the sequence of SEQ ID NO:68; and (c) tyrosine at position 3 in the sequence of SEQ ID NO:69.

In one embodiment, an anti-IL-8 antibody of Disclosure C comprises amino acid substitutions at the following positions: (a) alanine at position 6 in the sequence of SEQ ID NO:68; (b) glycine at position 8 in the sequence of SEQ ID NO:68; (d) tyrosine at position 9 in the sequence of SEQ ID NO:68; (e) arginine at position 11 in the sequence of SEQ ID NO:68; and (f) tyrosine at position 3 in the sequence of SEQ ID NO:69.

In one embodiment, an anti-IL-8 antibody of Disclosure C comprises: (a) substitution of alanine with aspartic acid at position 6 in the sequence of SEQ ID NO:68; (b) substitution of arginine with proline at position 11 in the sequence of SEQ ID NO:68; and (c) substitution of tyrosine with histidine at position 3 in the sequence of SEQ ID NO:69.

In one embodiment, an anti-IL-8 antibody of Disclosure C comprises: (a) substitution of glycine with tyrosine at position 8 in the sequence of SEQ ID NO:68; and (b) substitution of tyrosine with histidine at position 9 in the sequence of SEQ ID NO:68.

In one embodiment, an anti-IL-8 antibody of Disclosure C comprises: (a) substitution of alanine with aspartic acid at position 6 in the sequence of SEQ ID NO:68; (b) substitution of glycine with tyrosine at position 8 in the sequence of SEQ ID NO:68; (c) substitution of tyrosine with histidine at position 9 in the sequence of SEQ ID NO:68; (d) substitution of arginine with proline at position 11 in the sequence of SEQ ID NO:68; and (e) substitution of tyrosine with histidine at position 3 in the sequence of SEQ ID NO:69.

In one embodiment, an anti-IL-8 antibody of Disclosure C comprises HVR-H2 which comprises the amino acid sequence of SEQ ID NO:73.

In one embodiment, an anti-IL-8 antibody of Disclosure C comprises HVR-H3 which comprises the amino acid sequence of SEQ ID NO:74.

In one embodiment, an anti-IL-8 antibody of Disclosure C comprises HVR-H1 comprising the amino acid sequence of SEQ ID NO:67, HVR-H2 comprising the amino acid sequence of SEQ ID NO:73, and HVR-H3 comprising the amino acid sequence of SEQ ID NO:74.

In one embodiment, an anti-IL-8 antibody of Disclosure C comprises one or more amino acid substitution(s) at position(s) selected from the group consisting of: (a) serine at position 8 in the sequence of SEQ ID NO:70; (b) asparagine at position 1 in the sequence of SEQ ID NO:71; (c) leucine at position 5 in the sequence of SEQ ID NO:71; and (d) glutamine at position 1 in the sequence of SEQ ID NO:72. In a further embodiment, the anti-IL-8 antibody comprises a combination of any 2, 3, or all 4 of these substitutions.

In one embodiment, an anti-IL-8 antibody of Disclosure C comprises combination(s) of amino acid substitutions at positions selected from the group consisting of: (a) serine at position 8 in the sequence of SEQ ID NO:70; (b) asparagine at position 1 in the sequence of SEQ ID NO:71; (c) leucine at position 5 in the sequence of SEQ ID NO:71; and (d) glutamine at position 1 in the sequence of SEQ ID NO:72. In a further embodiment, the anti-IL-8 antibody comprises a combination of any 2, 3, or all 4 of these substitutions.

In one embodiment, an anti-IL-8 antibody of Disclosure C comprises amino acid substitutions at the following positions: (a) asparagine at position 1 in the sequence of SEQ ID NO:71; (b) leucine at position 5 in the sequence of SEQ ID NO:71; and (c) glutamine at position 1 in the sequence of SEQ ID NO:72.

In one embodiment, an anti-IL-8 antibody of Disclosure C comprises amino acid substitutions at the following positions: (a) serine at position 8 in the sequence of SEQ ID NO:70; (b) asparagine at position 1 in the sequence of SEQ ID NO:71; (c) leucine at position 5 in the sequence of SEQ ID NO:71; and (d) glutamine at position 1 in the sequence of SEQ ID NO:72.

In one embodiment, an anti-IL-8 antibody of Disclosure C comprises: (a) substitution of asparagine with lysine at position 1 in the sequence of SEQ ID NO:71; (b) substitution of leucine with histidine at position 5 in the sequence of SEQ ID NO:71; and (c) substitution of glutamine with lysine at position 1 in the sequence of SEQ ID NO:72.

In one embodiment, an anti-IL-8 antibody of Disclosure C comprises: (a) substitution of serine with glutamic acid at position 8 in the sequence of SEQ ID NO:70; (b) substitution of asparagine with lysine at position 1 in the sequence of SEQ ID NO:71; (c) substitution of leucine with histidine at position 5 in the sequence of SEQ ID NO:71; and (c) substitution of glutamine with lysine at position 1 in the sequence of SEQ ID NO:72.

In one embodiment, an anti-IL-8 antibody of Disclosure C comprises HVR-L2 comprising the amino acid sequence of SEQ ID NO:75.

In one embodiment, an anti-IL-8 antibody of Disclosure C comprises HVR-L3 comprising the amino acid sequence of SEQ ID NO:76.

In one embodiment, an anti-IL-8 antibody of Disclosure C comprises HVR-L1 comprising the amino acid sequence of SEQ ID NO:70, HVR-L2 comprising the amino acid sequence of SEQ ID NO:75, and HVR-L3 comprising the amino acid sequence of SEQ ID NO:76.

In one embodiment, an anti-IL-8 antibody of Disclosure C comprises amino acid substitutions at the following positions: (a) alanine at position 55 in the sequence of SEQ ID NO:77; (b) glycine at position 57 in the sequence of SEQ ID NO:77; (c) tyrosine at position 58 in the sequence of SEQ ID NO:77; (d) arginine at position 60 in the sequence of SEQ ID NO:77; (e) glutamine at position 84 in the sequence of SEQ ID NO:77; (f) serine at position 87 in the sequence of SEQ ID NO:77; and (g) tyrosine at position 103 in the sequence of SEQ ID NO:77.

In one embodiment, an anti-IL-8 antibody of Disclosure C comprises: (a) substitution of alanine with aspartic acid at position 55 in the sequence of SEQ ID NO:77; (b) substitution of glycine with tyrosine at position 57 in the sequence of SEQ ID NO:77; (c) substitution of tyrosine with histidine at position 58 in the sequence of SEQ ID NO:77; (d) substitution of arginine with proline at position 60 in the sequence of SEQ ID NO:77; (e) substitution of glutamine with threonine at position 84 in the sequence of SEQ ID NO:77; (f) substitution of serine with aspartic acid at position 87 in the sequence of SEQ ID NO:77; (g) and substitution of tyrosine with histidine at position 103 in the sequence of SEQ ID NO:77.

In one embodiment, an anti-IL-8 antibody of Disclosure C comprises a heavy chain variable region comprising the amino acid sequence of SEQ ID NO:78.

In one embodiment, an anti-IL-8 antibody of Disclosure C comprises a light chain variable region comprising the amino acid sequence of SEQ ID NO:79.

In one embodiment, an anti-IL-8 antibody of Disclosure C comprises a heavy chain variable region comprising the amino acid sequence of SEQ ID NO:78 and a light chain variable region comprising the amino acid sequence of SEQ ID NO:79. The anti-IL-8 antibody that comprises a heavy chain variable region comprising the amino acid sequence of SEQ ID NO:78 and a light chain variable region comprising the amino acid sequence of SEQ ID NO:79 may be an anti-IL-8 antibody that binds to IL-8 in a pH-dependent manner. The anti-IL-8 antibody that comprises a heavy chain variable region comprising the amino acid sequence of SEQ ID NO:78 and a light chain variable region comprising the amino acid sequence of SEQ ID NO:79 may be an anti-IL-8 antibody that maintains the IL-8-neutralizing activity stably in vivo (for example, in plasma). The anti-IL-8 antibody that comprises a heavy chain variable region comprising the amino acid sequence of SEQ ID NO:78 and a light chain variable region comprising the amino acid sequence of SEQ ID NO:79 may be an antibody with low immunogenicity.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:102; (b) HVR-H2 comprising the amino acid sequence of SEQ ID NO:103; (c) HVR-H3 comprising the amino acid sequence of SEQ ID NO:104; (d) HVR-L1 comprising the amino acid sequence of SEQ ID NO:105; (e) HVR-L2 comprising the amino acid sequence of SEQ ID NO:106; and (f) HVR-L3 comprising the amino acid sequence of SEQ ID NO:107.

In an alternative aspect, anti-IL-8 antibodies of Disclosure C also include those that have pH-dependent affinity for IL-8 and contain at least one amino acid substitution in an amino acid sequence of: (a) HVR-H1 comprising the amino acid sequence of SEQ ID NO:108; (b) HVR-H2 comprising the amino acid sequence of SEQ ID NO:109; (c) HVR-H3 comprising the amino acid sequence of SEQ ID NO:110; (d) HVR-L1 comprising the amino acid sequence of SEQ ID NO:111; (e) HVR-L2 comprising the amino acid sequence of SEQ ID NO:112; and (f) HVR-L3 comprising the amino acid sequence of SEQ ID NO:113.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:114; (b) HVR-H2 comprising the amino acid sequence of SEQ ID NO:115; (c) HVR-H3 comprising the amino acid sequence of SEQ ID NO:116; (d) HVR-L1 comprising the amino acid sequence of SEQ ID NO:117; (e) HVR-L2 comprising the amino acid sequence of SEQ ID NO:118; and (f) HVR-L3 comprising the amino acid sequence of SEQ ID NO:119.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:120; (b) HVR-H2 comprising the amino acid sequence of SEQ ID NO:121; (c) HVR-H3 comprising the amino acid sequence of SEQ ID NO:122; (d) HVR-L1 comprising the amino acid sequence of SEQ ID NO:123; (e) HVR-L2 comprising the amino acid sequence of SEQ ID NO:124; and (f) HVR-L3 comprising the amino acid sequence of SEQ ID NO:125.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:126; (b) HVR-H2 comprising the amino acid sequence of SEQ ID NO:127; (c) HVR-H3 comprising the amino acid sequence of SEQ ID NO:128; (d) HVR-L1 comprising the amino acid sequence of SEQ ID NO:129; (e) HVR-L2 comprising the amino acid sequence of SEQ ID NO:130; and (f) HVR-L3 comprising the amino acid sequence of SEQ ID NO:131.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:132; (b) HVR-H2 comprising the amino acid sequence of SEQ ID NO:133; (c) HVR-H3 comprising the amino acid sequence of SEQ ID NO:134; (d) HVR-L1 comprising the amino acid sequence of SEQ ID NO:135; (e) HVR-L2 comprising the amino acid sequence of SEQ ID NO:136; and (f) HVR-L3 comprising the amino acid sequence of SEQ ID NO:137.

In an alternative aspect, anti-IL-8 antibodies of Disclosure C also include those that have pH-dependent affinity for IL-8 and contain at least one amino acid substitution in at least any one amino acid sequence of: (a) HVR-H1 comprising the amino acid sequence of SEQ ID NO:138; (b) HVR-H2 comprising the amino acid sequence of SEQ ID NO:139; (c) HVR-H3 comprising the amino acid sequence of SEQ ID NO:140; (d) HVR-L1 comprising the amino acid sequence of SEQ ID NO:141; (e) HVR-L2 comprising the amino acid sequence of SEQ ID NO:142; and (f) HVR-L3 comprising the amino acid sequence of SEQ ID NO:143.

In one embodiment, an anti-IL-8 antibody of Disclosure C has IL-8-neutralizing activity. The IL-8-neutralizing activity refers to an activity of inhibiting the biological activity of IL-8, or may refer to an activity of inhibiting the receptor binding of IL-8.

In alternative aspect, an anti-IL-8 antibody of Disclosure C is an anti-IL-8 antibody that binds to IL-8 in a pH-dependent manner. In the context of Disclosure C, an anti-IL-8 antibody that binds to IL-8 in a pH-dependent manner refers to an antibody whose binding affinity for IL-8 at an acidic pH has been reduced as compared to the binding affinity for IL-8 at a neutral pH. For example, pH-dependent anti-IL-8 antibodies include antibodies that have a higher affinity for IL-8 at a neutral pH than at an acidic pH. In one embodiment, an anti-IL-8 antibody of Disclosure C has an IL-8 affinity at a neutral pH that is at least 2 times, 3 times, 5 times, 10 times, 15 times, 20 times, 25 times, 30 times, 35 times, 40 times, 45 times, 50 times, 55 times, 60 times, 65 times, 70 times, 75 times, 80 times, 85 times, 90 times, 95 times, 100 times, 200 times, 400 times, 1000 times, 10000 times or more greater than the affinity at an acidic pH. The binding affinity can be measured using, without particular limitations, surface plasmon resonance methods (such as BIACORE®). The association rate constant (kon) and dissociation rate constant (koff) can be calculated using the BIACORE® T200 Evaluation Software (GE Healthcare) based on a simple one-to-one Langmuir binding model by fitting the association and dissociation sensorgrams simultaneously. The equilibrium dissociation constant (KD) is calculated as a ratio of koff/kon. To screen for antibodies whose binding affinity varies depending on pH, without particular limitations, ELISA, kinetic exclusion assay (KinExA™), and others as well as surface plasmon resonance methods (such as BIACORE®) can be used. The pH-dependent IL-8-binding ability refers to the property to bind IL-8 in a pH-dependent manner. Meanwhile, whether an antibody is capable of binding to IL-8 multiple times can be assessed by the methods described in WO2009/125825.

In one embodiment, it is preferable that an anti-IL-8 antibody of Disclosure C has a small dissociation constant (KD) for IL-8 at a neutral pH. In one embodiment, the dissociation constant of an antibody of Disclosure C for IL-8 at a neutral pH is, for example, 0.3 nM or less, but is not limited thereto. In one embodiment, the dissociation constant of an antibody of Disclosure C for IL-8 at a neutral pH is, for example, 0.1 nM or less, but is not limited thereto. In one embodiment, the dissociation constant of an antibody of Disclosure C for IL-8 at a neutral pH is, for example, 0.03 nM or less, but is not limited thereto.

In one embodiment, it is preferable that an anti-IL-8 antibody of Disclosure C has a small dissociation constant (KD) for IL-8 at pH 7.4. In one embodiment, the dissociation constant of an antibody of Disclosure C for IL-8 at pH 7.4 is, for example, 0.3 nM or less, but is not limited thereto. In one embodiment, the dissociation constant of an antibody of Disclosure C for IL-8 at pH 7.4 is, for example, 0.1 nM or less, but is not limited thereto. In one embodiment, the dissociation constant of an antibody of Disclosure C for IL-8 at pH 7.4 is, for example, 0.03 nM or less, but is not limited thereto.

In one embodiment, it is preferable that an anti-IL-8 antibody of Disclosure C has a large dissociation constant (KD) for IL-8 at an acidic pH. In one embodiment, the dissociation constant of an antibody of Disclosure C for IL-8 at an acidic pH is, for example, 3 nM or more, but is not limited thereto. In one embodiment, the dissociation constant of an antibody of Disclosure C for IL-8 at an acidic pH is, for example, 10 nM or more, but is not limited thereto. In one embodiment, the dissociation constant of an antibody of Disclosure C for IL-8 at an acidic pH is, for example, 30 nM or more, but is not limited thereto.

In one embodiment, it is preferable that an anti-IL-8 antibody of Disclosure C has a large dissociation constant (KD) for IL-8 at pH 5.8. In one embodiment, the dissociation constant of an antibody of Disclosure C for IL-8 at pH 5.8 is, for example, 3 nM or more, but is not limited thereto. In one embodiment, the dissociation constant of an antibody of Disclosure C for IL-8 at pH 5.8 is, for example, 10 nM or more, but is not limited thereto. In one embodiment, the dissociation constant of an antibody of Disclosure C for IL-8 at pH 5.8 is, for example, 30 nM or more, but is not limited thereto.

In one embodiment, it is preferable that the binding affinity of an anti-IL-8 antibody of Disclosure C for IL-8 is greater at a neutral pH than at an acidic pH.

In one embodiment, the dissociation constant ratio between acidic pH and neutral pH, [KD (acidic pH)/KD (neutral pH)], of an anti-IL-8 antibody of Disclosure C is, for example, 30 or more, but is not limited thereto. In one embodiment, the dissociation constant ratio between acidic pH and neutral pH, [KD (acidic pH)/KD (neutral pH)], of an anti-IL-8 antibody of Disclosure C is, for example, 100 or more, for example, 200, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, or 9500, but is not limited thereto.

In one embodiment, the dissociation constant ratio between pH 5.8 and pH 7.4, [KD (pH 5.8)/KD (pH 7.4)], of an anti-IL-8 antibody of Disclosure C is 30 or more, but is not limited thereto. In one embodiment, the dissociation constant ratio between pH 5.8 and pH 7.4, [KD (pH 5.8)/KD (pH 7.4)], of an antibody of Disclosure C is, for example, 100 or more, for example, 200, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, or 9500, but is not limited thereto.

In one embodiment, it is preferable that an anti-IL-8 antibody of Disclosure C has a large dissociation rate constant (koff) at an acidic pH. In one embodiment, the dissociation rate constant of an antibody of Disclosure C at an acidic pH is, for example, 0.003 (1/s) or more, but is not limited thereto. In one embodiment, the dissociation rate constant of an antibody of Disclosure C at an acidic pH is, for example, 0.005 (1/s) or more, but is not limited thereto. In one embodiment, the dissociation rate constant of an antibody of Disclosure C at an acidic pH is, for example, 0.01 (1/s) or more, but is not limited thereto.

In one embodiment, it is preferable that an anti-IL-8 antibody of Disclosure C has a large dissociation rate constant (koff) at pH 5.8. In one embodiment, the dissociation rate constant of an antibody of Disclosure C at pH 5.8 is, for example, 0.003 (1/s) or more, but is not limited thereto. In one embodiment, the dissociation rate constant of an antibody of Disclosure C at pH 5.8 is, for example, 0.005 (1/s) or more, but is not limited thereto. In one embodiment, the dissociation rate constant of an antibody of Disclosure C at pH 5.8 is, for example, 0.01 (1/s) or more, but is not limited thereto.

In one embodiment, it is preferable that the anti-IL-8 antibody of Disclosure C maintains the IL-8-neutralizing activity stably in a solution (for example, in PBS). Whether the activity is maintained stably in a solution can be assessed by measuring whether the IL-8-neutralizing activity of the antibody of Disclosure C added to the solution changes before and after storage for a certain period of time at a certain temperature. In one embodiment, the storage period is, for example, one, two, three, or four weeks, but is not limited thereto. In one embodiment, the storage temperature is, for example, 25° C., 30° C., 35° C., 40° C., or 50° C., but is not limited thereto. In one embodiment, the storage temperature is, for example, 40° C., but is not limited thereto; and the storage period is, for example, two weeks, but is not limited thereto. In one embodiment, the storage temperature is, for example, 50° C., but is not limited thereto; and the storage period is, for example, one week, but is not limited thereto.

In one embodiment, it is preferable that the anti-IL-8 antibody of Disclosure C maintains the IL-8-neutralizing activity stably in vivo (for example, in plasma). Whether the activity is maintained stably in vivo can be assessed by measuring whether the IL-8-neutralizing activity of the antibody of Disclosure C added to plasma of an animal (for example, mouse) or human changes before and after storage for a certain period of time at a certain temperature. In one embodiment, the storage period is, for example, one, two, three, or four weeks, but is not limited thereto. In one embodiment, the storage temperature is, for example, 25° C., 30° C., 35° C., or 40° C., but is not limited thereto. In one embodiment, the storage temperature is, for example, 40° C., but is not limited thereto; and the storage period is, for example, two weeks, but is not limited thereto.

In one embodiment, the rate of cellular uptake of an anti-IL-8 antibody of Disclosure C is greater when the antibody forms a complex with IL-8 than the antibody alone. The IL-8 antibody of Disclosure C is more easily taken up into cells when it is complexed with IL-8 outside of cells (for example, in plasma) than when not complexed with IL-8.

In one embodiment, it is preferable that the predicted immunogenicity of an anti-IL-8 antibody of Disclosure C, which is predicted in human hosts, is reduced. "Low immunogenicity" may mean, without being limited thereto, for example, that the administered anti-IL-8 antibody does not induce immune response of a living body in at least half or more of the individuals administered with a sufficient amount of the antibody for a sufficient period of time to achieve therapeutic efficacy. The induction of immune response may include production of anti-drug antibodies. "Low anti-drug antibody production" is interchangeable with "low immunogenicity". The immunogenicity level in human can be estimated with a T cell epitope prediction program. Such T cell epitope prediction programs include Epibase (Lonza), iTope/TCED (Antitope), EpiMatrix (EpiVax), and so on. EpiMatrix is a system for predicting the immunogenicity of a protein of interest where sequences of peptide fragments are automatically designed by partitioning the amino acid sequence of a protein being analyzed for its immunogenicity into nine amino acids each to predict their ability to bind to eight major MHC Class II alleles (DRB1*0101, DRB1*0301, DRB1*0401, DRB1*0701, DRB1*0801, DRB1*1101, DRB1*1301, and DRB1*1501) (De Groot et al., *Clin. Immunol.* 131(2):189-201 (2009)). Sequences in which amino acids of the amino acid sequence of an anti-IL-8 antibody have been modified can be analyzed using the above-described T cell epitope prediction programs to design sequences with reduced immunogenicity. Preferred sites of amino acid modification to reduce the immunogenicity of the anti-IL-8 antibody of Disclosure C include, but are not limited to, the amino acids at position 81 and/or position 82b according to Kabat numbering in the heavy-chain sequence of the anti-IL-8 antibody shown in SEQ ID NO:78.

In one embodiment, Disclosure C provides methods for enhancing elimination of IL-8 from an individual as compared to when using a reference antibody, comprising administering an anti-IL-8 antibody of Disclosure C to the individual. In one embodiment, Disclosure C relates to the use of an anti-IL-8 antibody of Disclosure C in the enhancement of the elimination of IL-8 from an individual as compared to when using a reference antibody. In one embodiment, Disclosure C relates to an anti-IL-8 antibody of Disclosure C for use in the enhancement of the elimination of IL-8 from an individual as compared to when using a reference antibody. In one embodiment, Disclosure C relates to the use of an anti-IL-8 antibody of Disclosure C in the production of pharmaceutical compositions for enhancing the elimination of IL-8 in vivo as compared to when using a control antibody. In one embodiment, Disclosure C relates to pharmaceutical compositions comprising an anti-IL-8 antibody of Disclosure C for enhancing the elimination of IL-8 as compared to when using a reference antibody. In one embodiment, Disclosure C relates to methods for enhancing the elimination of IL-8 as compared to when using a reference antibody, comprising administering an anti-IL-8 antibody of Disclosure C to a subject. In the embodiments of Disclosure C, the reference antibody refers to an anti-IL-8 antibody before modification to obtain the antibody of Disclosure C, or an antibody whose IL-8 binding affinity is strong at both acidic and neutral pHs. The reference antibody may be an antibody comprising the amino acid sequence of SEQ ID NOs:83 and 84, or SEQ ID NOs:89 and 87.

In one embodiment, Disclosure C provides pharmaceutical compositions comprising an anti-IL-8 antibody of Disclosure C, characterized that the anti-IL-8 antibody of Disclosure C binds to IL-8 and then to extracellular matrix. In one embodiment, Disclosure C relates to the use of an anti-IL-8 antibody of Disclosure C in producing pharmaceutical compositions characterized that the anti-IL-8 antibody of Disclosure C binds to IL-8 and then to extracellular matrix.

In any of the embodiments described above, the anti-IL-8 antibody may be a humanized antibody.

In one aspect, the antibody of Disclosure C comprises the heavy chain variable region of any one of the embodiments described above and the light chain variable region of any one of the embodiments described above. In one embodiment, the antibody of Disclosure C comprises each of the heavy-chain variable region of SEQ ID NO:78 and the light-chain variable region of SEQ ID NO:79, and also may comprise post-translational modifications in their sequences.

In a further aspect, an anti-IL-8 antibody according to any one of the embodiments described above may incorporate, singly or in combination, any of the features described in Sections 1 to 7 below.

1. Chimeric Antibody and Humanized Antibody

In certain embodiments, an antibody provided in Disclosure C may be a chimeric antibody. Certain chimeric antibodies are described, for example, in U.S. Pat. No. 4,816,567; and Morrison et al., *Proc. Natl. Acad. Sci. USA* 81:6851-6855 (1984). In one example, a chimeric antibody may comprise a non-human variable region (e.g., a variable region derived from a mouse, a rat, a hamster, a rabbit, or a non-human primate such as a monkey) and a human constant region.

In certain embodiments, a chimeric antibody is a humanized antibody. Typically, a non-human antibody is humanized to reduce immunogenicity in humans, while retaining the specificity and affinity of the parental non-human antibody. Generally, a humanized antibody comprises one or more variable regions in which HVRs, e.g., CDRs (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody may be substituted with corresponding residues from a non-human antibody (e.g., the antibody from which the HVR residues are derived), for example, to retain or improve antibody specificity or affinity.

Humanized antibodies and methods of making them are reviewed, for example, in Almagro et al., *Front. Biosci.* 13:1619-1633 (2008), and are further described, for example, in Riechmann et al., *Nature* 332:323-329 (1988); Queen et al., *Proc. Natl Acad. Sci. USA* 86:10029-10033 (1989); U.S. Pat. Nos. 5,821,337, 7,527,791, 6,982,321, and 7,087,409; Kashmiri et al., *Methods* 36:25-34 (2005) (describing specificity determining region (SDR) grafting); Padlan, *Mol. Immunol.* 28:489-498 (1991) (describing "resurfacing"); Dall'Acqua et al., *Methods* 36:43-60 (2005) (describing "FR shuffling"); and Osbourn et al., *Methods* 36:61-68 (2005) and Klimka et al., *Br. J. Cancer* 83:252-260 (2000) (describing the "guided selection" approach to FR shuffling).

Human framework regions that may be used for humanization include but are not limited to framework regions selected using the "best-fit" method (see, e.g., Sims et al., *J. Immunol.* 151:2296 (1993)); framework regions derived from the consensus sequence of human antibodies of a particular subgroup of light or heavy chain variable regions (see, e.g., Carter et al., Proc. Natl. Acad. Sci. USA, 89:4285 (1992); and Presta et al., *J. Immunol.*, 151:2623 (1993)); and framework regions derived from screening FR libraries (see, e.g., Baca et al., *J. Biol. Chem.* 272:10678-10684 (1997) and Rosok et al., J. Biol. Chem. 271:22611-22618 (1996)).

2. Antibody Fragments

In certain embodiments, an antibody provided in Disclosure C may be an antibody fragment. Antibody fragments include, but are not limited to, Fab, Fab', Fab'-SH, F(ab')$_2$, Fv, and scFv fragments, and other fragments described below. For a review of certain antibody fragments, see Hudson et al., *Nat. Med.* 9:129-134 (2003). For a review of scFv fragments, see for example, Pluckthün, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458.

Diabodies are antibody fragments with two antigen-binding sites that may be bivalent or bispecific. See, for example, EP 404,097; WO 1993/01161; Hudson et al., *Nat. Med.* 9:129-134 (2003); and Hollinger et al., *Proc. Natl. Acad. Sci. USA* 90:6444-6448 (1993). Triabodies and tetrabodies are also described in Hudson et al., *Nat. Med.* 9:129-134 (2003).

Single-domain antibodies are antibody fragments comprising all or a portion of the heavy chain variable domain or all or a portion of the light chain variable domain of an antibody. In certain embodiments, a single-domain antibody may be a human single-domain antibody (Domantis, Inc., Waltham, Mass.; see, e.g., U.S. Pat. No. 6,248,516 B1). Antibody fragments can be made by various techniques, including but not limited to proteolytic digestion of an intact antibody as well as production by recombinant host cells (e.g., *E. coli* or phage), as described within the scope of the description of Disclosure C herein.

3. Human Antibody

In certain embodiments, an antibody provided in Disclosure C may be a human antibody. Human antibodies can be prepared by various techniques known in the art. Human antibodies are described in general terms in van Dijk and van de Winkel, *Curr. Opin. Pharmacol.* 5:368-74 (2001) and Lonberg, *Curr. Opin. Immunol.* 20:450-459 (2008). Human antibodies may be prepared by administering an immunogen to a transgenic animal that has been modified to produce intact human antibodies or intact antibodies with human variable regions in response to antigenic challenge. Such animals typically contain all or a portion of the humans immunoglobulin loci, which replace the immunoglobulin loci of the animal (non-human), or are present extrachromosomally or integrated randomly into the animal's chromosomes. In such transgenic mice, the immunoglobulin loci of the animal (non-human) have generally been inactivated. For review of methods for obtaining human antibodies from transgenic animals, see Lonberg, *Nat. Biotech.* 23:1117-1125 (2005). See also U.S. Pat. Nos. 6,075,181 and 6,150,584 for XENOMOUSE™ technology; U.S. Pat. No. 5,770,429 for HUMAB™ technology; U.S. Pat. No. 7,041,870 for K-M MOUSE™ technology, and US Patent Appl. Publ. No. US 2007/0061900 for VELOCIMOUSE™ technology.

Human variable regions from intact antibodies produced by such animals may be further modified, for example, by combining with a different human constant region. Human antibodies can also be prepared by hybridoma-based methods. Human myeloma and mouse-human heteromyeloma cell lines for the production of human monoclonal antibodies are described, for example, in Kozbor, *J. Immunol.* 133:3001 (1984); Brodeur et al., Monoclonal Antibody Production Techniques and Applications, pp. 51-63 (Marcel Dekker, Inc., New York, 1987); and Boerner et al., *J. Immunol.* 147:86 (1991). Human antibodies generated via human B-cell hybridoma are described in Li et al., *Proc. Natl. Acad. Sci. USA* 103:3557-3562 (2006). Additional methods include, for example, the method described in U.S. Pat. No. 7,189,826, for the production of monoclonal human IgM antibodies from hybridoma cell lines, as well as, for example, the method described in Ni, Xiandai Mianyixue, 26 (4):265-268 (2006), for human-human hybridomas. Human hybridoma technology (trioma technology) is also described in Vollmers et al., *Histol. and Histopath.* 20(3): 927-937 (2005) and Vollmers et al., *Methods and Findings in Experimental and Clinical Pharmacology* 27(3):185-91 (2005). Human antibodies may also be generated by isolating Fv clone variable domain sequences selected from human-derived phage display libraries. Such variable domain sequences can be combined with a desired human constant domain. Techniques for selecting human antibodies from antibody libraries are described below.

4. Library-Derived Antibodies

Antibodies of Disclosure C can be isolated by screening combinatorial libraries for antibodies with the desired activity or activities. For example, various methods are known in the art for generating phage display libraries and screening such libraries for antibodies possessing desired binding characteristics. Such methods are reviewed in Hoogenboom et al., in *Meth. Mol. Biol.* 178:1-37 (O'Brien et al., ed., Human Press, Totowa, N. J., 2001), as wells as, for example, in McCafferty et al., *Nature* 348:552-554 (1990); Clackson et al., *Nature* 352:624-628 (1991); Marks et al., *J. Mol. Biol.* 222:581-597 (1992); *Marks and Bradbury*, in *Meth. Mol. Biol.* 248:161-175 (Lo, ed., Human Press, Totowa, N. J., 2003); Sidhu et al., *J. Mol. Biol.* 338(2):299-310 (2004); Lee et al., *J. Mol. Biol.* 340(5):1073-1093 (2004); *Fellouse, Proc. Natl. Acad. Sci. USA* 101(34):12467-12472 (2004); and Lee et al., *J. Immunol. Meth.* 284(1-2):119-132 (2004).

In certain phage display methods, repertoires of VH and VL coding sequences may be separately cloned by polymerase chain reaction (PCR) and recombined randomly in phage libraries. The resulting phage libraries are screened for antigen-binding phage as described in Winter et al., *Ann. Rev. Immunol.* 12:433-455 (1994). Phage typically display antibody fragments, either as single-chain Fv (scFv) fragments or as Fab fragments.

Alternatively, the naïve repertoire can be cloned (for example, from human) to provide a single source of antibodies to a wide range of non-self and also self antigens without any immunization as described by Griffiths et al., *EMBO J.* 12:725-734 (1993).

Finally, naïve libraries can also be constructed synthetically by cloning unrearranged V-gene segments from stem cells, and using PCR primers containing random sequences to encode the highly variable CDR3 regions and to accomplish rearrangement in vitro (see below and Hoogenboom and Winter, *J. Mol. Biol.*, 227:381-388 (1992); patent publications that describe human antibody phage libraries include, for example: U.S. Pat. No. 5,750,373; and US Appl. Publ. Nos. 2005/0079574, 2005/0119455, 2005/0266000, 2007/0117126, 2007/0160598, 2007/0237764, 2007/0292936, and 2009/0002360. Here, antibodies or antibody fragments isolated from human antibody libraries are considered to be human antibodies or human antibody fragments.

5. Multispecific Antibody

In certain embodiments, an antibody provided according to Disclosure C may be, for example, a multispecific antibody such as a bispecific antibody. Multispecific antibodies are monoclonal antibodies that have binding specificities for at least two different sites.

In certain embodiments, one of the binding specificities is for IL-8, and the others are for any other antigens.

In certain embodiments, bispecific antibodies may bind to two different epitopes on IL-8. Bispecific antibodies may also be used to localize cytotoxic agents to cells that express IL-8. Bispecific antibodies may be prepared as full length antibodies or as antibody fragments.

Techniques for making multispecific antibodies include, but are not limited to, recombinant co-expression of two immunoglobulin heavy chain-light chain pairs having different specificities (see Milstein and Cuello, *Nature* 305:537 (1983)); WO 93/08829; and Traunecker et al., *EMBO J.* 10:3655 (1991)) and the "knob-in-hole" method (see U.S. Pat. No. 5,731,168). Multispecific antibodies can be made by using electrostatic steering effects to prepare Fc-heterodimeric molecules (WO 2009/089004A1), by crosslinking two or more antibodies or fragments (U.S. Pat. No. 4,676,980; and Brennan et al., *Science* 229:81 (1985)), by using leucine zippers to produce bispecific antibodies (Kostelny et al., *J. Immunol.* 148(5):1547-1553 (1992)), by using "diabody" technology to make bispecific antibody fragments (Hollinger et al., *Proc. Natl. Acad. Sci. USA* 90:6444-6448 (1993)), by using single-chain Fv (sFv) dimers (Gruber et al., *J. Immunol.* 152:5368 (1994)), or other methods. Preparation of trispecific antibodies is described, for example, in Tutt et al., *J. Immunol.* 147:60 (1991).

Engineered antibodies with three or more functional antigen binding sites, including "Octopus antibodies", are also included herein (see, e.g., US 2006/0025576).

Within the scope of the description of Disclosure C herein, the antibody or antibody fragment also includes a "Dual Acting FAb" or "DAF" comprising an antigen binding site that binds to IL-8 as well as another, different antigen (see US 2008/0069820, for example).

6. Antibody Variants

Amino acid sequence variants of an antibody can be prepared by introducing appropriate modifications into a nucleotide sequence encoding the antibody, or by peptide synthesis. Such modifications include, for example, deletions, and/or insertions, and/or substitutions of residues in the amino acid sequence of the antibody. A final construct can be attained with any combination of deletion, insertion, and substitution, as long as the final construct is an antibody that has the desired properties described in the context of Disclosure C.

In one embodiment, Disclosure C provides antibody variants having one or more amino acid substitutions. Such substitution sites may be any positions in an antibody. Amino acids for conservative substitutions are shown in Table 10 under the heading of "conservative substitutions". Amino acids for typical substitutions that result in more substantial changes are shown in Table 10 under the heading of "typical substitutions", and as further described in reference of amino acid side chain classes.

TABLE 10

| Original Residue | Typical Substitution | Conservative Substitution |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln: Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; and (6) aromatic: Trp, Tyr, Phe.

Non-conservative substitutions will entail exchanging a member of one of these classes for another class.

Amino acid insertions include fusion of a polypeptide comprising one, two, or three to one hundred or more residues at the N terminus and/or C terminus, as well as insertion of one or more amino acid residues into a sequence. Antibodies with such terminal insertion include, for example, antibodies with an N-terminal methionyl residue. Other insertional variants of the antibody molecule include those that result from N- or C-terminal fusion of the antibody to an enzyme (for example, ADEPT) or a polypeptide that increases plasma half-life of antibody.

7. Glycosylated Variants

In one embodiment, antibodies provided according to Disclosure C may be glycosylated antibodies. Glycosylation sites can be added to or deleted from an antibody by altering amino acid sequences in such a way as to create or remove glycosylation sites.

When an antibody comprises an Fc region, the sugar chain attached thereto can be altered. Naïve antibodies produced by mammalian cells typically contain a branched, biantennary oligosaccharide, which is attached by an N-linkage to Asn297 of the CH2 domain of the Fc region (see Wright et al. *TIBTECH* 15:26-32 (1997)). The oligosaccharide includes, for example, mannose, N-acetylglucosamine (GlcNAc), galactose, and sialic acid, as well as fucose attached to GlcNAc in the "stem" of the biantennary oligosaccharide structure. In one embodiment, the oligosaccharide in the antibody of Disclosure C is modified to create antibody variants having certain improved properties.

8. Fc Region Variants

In one embodiment, one or more amino acid modifications are introduced into the Fc region of an antibody provided according to Disclosure C, thereby generating an Fc region variant. Fc region variants include those that have a modification (for example, a substitution) of one, two, three, or more amino acids in a native human Fc region sequence (for example, the Fc region of human IgG1, IgG2, IgG3, or IgG4).

An anti-IL-8 antibody of Disclosure C may contain an Fc region having at least one of the following five properties, without being limited thereto: (a) increased binding affinity for FcRn of the Fc region relative to the binding affinity for FcRn of a native Fc region at acidic pH; (b) reduced binding affinity of the Fc region for pre-existing ADA relative to the binding affinity of a native Fc region for the pre-existing ADA; (c) increased plasma half-life of the Fc region relative to the plasma half-life of a native Fc region; (d) reduced plasma clearance of the Fc region relative to the plasma clearance of a native Fc region; and (e) reduced binding affinity of the Fc region for an effector receptor relative to the binding affinity of a native Fc region for the effector receptor. In some embodiments, the Fc region has 2, 3 or 4 of the above-listed properties. In one embodiment, Fc region variants include those having an increased FcRn-binding affinity at an acidic pH. Fc region variants with increased FcRn-binding affinity include, but are not limited to, Fc region variants whose FcRn-binding affinity is increased up to 2-fold, 3-fold, 4-fold, 5-fold, 10-fold, 15-fold, 20-fold, 30-fold, 50-fold, or 100-fold as compared to the FcRn-binding affinity of an antibody comprising the native IgG Fc region.

In one embodiment, an Fc region variant includes a safe and advantageous Fc region variant that does not bind to pre-existing ADA, and at the same time has improved plasma retention. As used in the context of Disclosure C, the term "ADA" refers to an endogenous antibody having binding affinity for an epitope on a therapeutic antibody. As used in the context of Disclosure C, the term "pre-existing ADA" refers to a detectable anti-drug antibody present in a patient's blood prior to administration of a therapeutic antibody to the patient. Pre-existing ADA includes the rheumatoid factor. Fc region variants with low binding affinity for pre-existing ADA include, but are not limited to, Fc region variants whose ADA-binding affinity is reduced to ¹⁄₁₀ or less, ¹⁄₅₀ or less, or ¹⁄₁₀₀ or less as compared to the ADA-binding affinity of an antibody comprising the native IgG Fc region.

In one embodiment, an Fc region variant includes an Fc region variants whose binding affinity for complement proteins is low or that do not bind to complement proteins. Complement proteins include C1q. Fc region variants with low binding affinity for complement proteins include, but are not limited to, Fc region variants whose binding affinity for complement proteins is reduced to ¹⁄₁₀ or less, ¹⁄₅₀ or less, or ¹⁄₁₀₀ or less as compared to the complement protein-binding affinity of an antibody comprising a native IgG Fc region.

In one embodiment, an Fc region variant includes an Fc region variant whose binding affinity for effector receptors is low or that does not have the binding affinity for an effector receptor. The effector receptors include, but are not limited to, FcγRI, and FcγRIII. FcγRI includes, but is not limited to, FcγRIa, FcγRIb, and FcγRIc, as well as subtypes thereof. FcγRII includes, but is not limited to, FcγRIIa (which has two allotypes: R131 and H131) and FcγRIIb. FcγRIII includes, but is not limited to, FcγRIIIa (which has two allotypes: V158 and F158) and FcγRIIIb (which has two allotypes: FcγRIIIb-NA1 and FcγRIIIb-NA2). Fc region variants with low binding affinity for effector receptors include, but are not limited to, Fc region variants whose binding affinity for effector receptors is reduced to at least ¹⁄₁₀ or less, ¹⁄₅₀ or less, or ¹⁄₁₀₀ or less as compared to the binding affinity of an antibody comprising a native IgG Fc region.

In one embodiment, an Fc region variant includes an Fc region comprising one or more amino acid substitutions at any of the positions of the group consisting of positions 235, 236, 239, 327, 330, 331, 428, 434, 436, 438, and 440, according to EU numbering as compared to the native Fc region.

In one embodiment, an Fc region variant includes an Fc region comprising amino acid substitutions at positions 235, 236, 239, 428, 434, 436, 438, and 440, according to EU numbering as compared to the native Fc region.

In one embodiment, an Fc region variant includes an Fc region comprising amino acid substitutions at positions 235, 236, 327, 330, 331, 428, 434, 436, 438, and 440, according to EU numbering as compared to the native Fc region.

In one embodiment, an Fc region variant includes an Fc region comprising one or more amino acid substitutions selected from the group consisting of: L235R, G236R, S239K, A327G, A330S, P331S, M428L, N434A, Y436T, Q438R, and S440E.

In one embodiment, an Fc region variant includes an Fc region comprising the amino acid substitutions of M428L, N434A, Y436T, Q438R, and S440E.

In one embodiment, an Fc region variant includes an Fc region comprising the amino acid substitutions of L235R, G236R, S239K, M428L, N434A, Y436T, Q438R, and S440E.

In one embodiment, an Fc region variant includes an Fc region comprising the amino acid substitutions of L235R, G236R, A327G, A330S, P331S, M428L, N434A, Y436T, Q438R, and S440E.

In one embodiment, an anti-IL-8 antibody of Disclosure C comprises the amino acid sequence of SEQ ID NO:80 and/or the amino acid sequence of SEQ ID NO:82. The anti-IL-8 antibody comprising the amino acid sequence of SEQ ID NO:80 and/or the amino acid sequence of SEQ ID NO:82 may be an anti-IL-8 antibody that binds to IL-8 in a pH-dependent manner. The anti-IL-8 antibody comprising the amino acid sequence of SEQ ID NO:80 and/or the amino acid sequence of SEQ ID NO:82 may maintain IL-8-neutralizing activity stably in vivo (for example, in plasma). The anti-IL-8 antibody comprising the amino acid sequence of SEQ ID NO:80 and/or the amino acid sequence of SEQ ID NO:82 may be an antibody with low immunogenicity. The anti-IL-8 antibody comprising the amino acid sequence of SEQ ID NO:80 and/or the amino acid sequence of SEQ ID NO:82 may contain an Fc region whose FcRn-binding affinity at an acidic pH (e.g., pH 5.8) is increased as compared to the FcRn-binding affinity of a native Fc region at the acidic pH. The anti-IL-8 antibody comprising the amino acid sequence of SEQ ID NO:80 and/or the amino acid sequence of SEQ ID NO:82 may contain an Fc region whose binding affinity for pre-existing ADA is reduced as compared to the binding affinity of a native Fc region for pre-existing ADA. The anti-IL-8 antibody comprising the amino acid sequence of SEQ ID NO:80 and/or the amino acid sequence of SEQ ID NO:82 may contain an Fc region whose half-life in plasma is prolonged as compared to that of a native Fc region. The anti-IL-8 antibody comprising the amino acid sequence of SEQ ID NO:80 and/or the amino acid sequence of SEQ ID NO:82 may contain an Fc region whose binding affinity for effector receptors is reduced as compared to that of a native Fc region. In a further embodiment, the anti-IL-8 antibody comprises a combination of any 2, 3, 4, 5, 6, or all 7 of above-listed properties.

In one embodiment, an anti-IL-8 antibody of Disclosure C comprises the amino acid sequence of SEQ ID NO:81 and/or the amino acid sequence of SEQ ID NO:82. The anti-IL-8 antibody comprising the amino acid sequence of SEQ ID NO:81 and/or the amino acid sequence of SEQ ID NO:82 may be an anti-IL-8 antibody that binds to IL-8 in a pH-dependent manner. The anti-IL-8 antibody comprising the amino acid sequence of SEQ ID NO:81 and/or the amino acid sequence of SEQ ID NO:82 may maintain IL-8-neutralizing activity stably in vivo (for example, in plasma). The anti-IL-8 antibody comprising the amino acid sequence of SEQ ID NO:81 and/or the amino acid sequence of SEQ ID NO:82 may be an antibody with low immunogenicity. The anti-IL-8 antibody comprising the amino acid sequence of SEQ ID NO:81 and/or the amino acid sequence of SEQ ID NO:82 may contain an Fc region whose FcRn-binding affinity at an acidic pH is increased as compared to the FcRn-binding affinity of a native Fc region. The anti-IL-8 antibody comprising the amino acid sequence of SEQ ID NO:81 and/or the amino acid sequence of SEQ ID NO:82 may contain an Fc region whose binding affinity for pre-existing ADA is reduced as compared to the binding affinity of a native Fc region for pre-existing ADA. The anti-IL-8 antibody comprising the amino acid sequence of SEQ ID NO:81 and/or the amino acid sequence of SEQ ID NO:82 may contain an Fc region whose half-life in plasma is prolonged as compared to that of a native Fc region. The anti-IL-8 antibody comprising the amino acid sequence of SEQ ID NO:81 and/or the amino acid sequence of SEQ ID NO:82 may contain an Fc region whose binding affinity for effector receptors is reduced as compared to that of a native Fc region. In a further embodiment, the anti-IL-8 antibody comprises a combination of any 2, 3, 4, 5, 6, or all 7 of above-listed properties.

In certain embodiments, Disclosure C encompasses an antibody variant that possesses some but not all effector functions. The antibody variant can be a desirable candidate for cases in which certain effector functions (such as complement and ADCC) are unnecessary or deleterious. In vitro and/or in vivo cytotoxicity assays known in the art can routinely be conducted to confirm the reduction/complete loss of CDC and/or ADCC activities. For example, Fc receptor (FcR) binding assays can be conducted to confirm that an antibody lacks FcγR binding (hence lacking ADCC activity), but retains FcRn binding ability.

The primary cultured cells for mediating ADCC and NK cells express FcγRIII only, whereas monocytes express FcγRI, FcγRII and FcγRIII. FcR expression on hematopoietic cells is summarized in Table 3 on page 464 of Ravetch et al., Annu. Rev. Immunol. 9:457-492 (1991). Non-limiting examples of in vitro assays for assessing ADCC activity of a molecule of interest are described in U.S. Pat. No. 5,500,362 (see, e.g. Hellstrom. et al., Proc. Natl Acad. Sci. USA 83:7059-7063 (1986), Hellstrom et al., Proc. Natl Acad. Sci. USA 82:1499-1502 (1985); U.S. Pat. No. 5,821,337, and Bruggemann et al., J. Exp. Med. 166:1351-1361 (1987)). Alternatively, non-radioactive isotope assays are available for assessing effector cell function (see, for example, ACTI™ non-radioactive cytotoxicity assay for flow cytometry (CellTechnology, Inc. Mountain View, Calif.; and Cyto-Tox 96™ non-radioactive cytotoxicity assay (Promega, Madison, Wis.)). Effector cells useful for such assays include peripheral blood mononuclear cells (PBMC) and Natural Killer (NK) cells.

Alternatively or additionally, ADCC activity of an antibody variant of interest may be assessed in vivo, for example, in an animal model as disclosed in Clynes et al., Proc. Natl. Acad. Sci. USA 95:652-656 (1998). C1q binding assays may also be carried out to confirm that the antibody is unable to bind C1q and lacks CDC activity. See, e.g., C1q and C3c binding ELISA in WO 2006/029879 and WO 2005/100402. To assess complement activation, a CDC assay may be performed (see, e.g., Gazzano-Santoro et al., J. Immunol. Meth. 202:163 (1996); Cragg et al., Blood 101:1045-1052 (2003); and Cragg et al., Blood 103:2738-2743 (2004)). FcRn binding and in vivo clearance/half life determinations can be performed using methods known in the art (see, e.g., Petkova et al., Intl. Immunol. 18(12):1759-1769 (2006)).

Antibodies with reduced effector functions include those with substitution of one or more of Fc region residues at position 238, 265, 269, 270, 297, 327 or 329 (U.S. Pat. No. 6,737,056). Such Fc region variants include Fc region variants with substitutions at two or more of residues at position 265, 269, 270, 297 or 327, including the so-called "DANA" Fc region variants with substitution of residues 265 and 297 to alanine (U.S. Pat. No. 7,332,581).

Antibody variants with improved or diminished binding to FcR groups are described below. (See, e.g., U.S. Pat. No. 6,737,056; WO 2004/056312, and Shields et al., J. Biol. Chem. 9(2):6591-6604 (2001).)

Antibodies with increased blood half lives and improved FcRn binding at an acidic pH are described in US2005/0014934. The described antibodies comprise an Fc region with one or more substitutions that improve binding of the Fc region to FcRn. Such Fc region variants include those with substitutions at one or more of positions selected from 238, 256, 265, 272, 286, 303, 305, 307, 311, 312, 317, 340, 356, 360, 362, 376, 378, 380, 382, 413, 424 or 434 in an Fc region, for example, substitution of position 434 in an Fc region (U.S. Pat. No. 7,371,826).

See also Duncan et al., Nature 322:738-40 (1988); U.S. Pat. No. 5,648,260; U.S. Pat. No. 5,624,821; and WO 94/29351 for other examples of Fc region variants.

9. Antibody Derivatives

In certain embodiments, an antibody provided in Disclosure C may be further modified to contain additional nonproteinaceous moieties that are known in the art and readily available. The moieties suitable for derivatization of the antibody include, but are not limited, to water soluble polymers. Examples of water soluble polymers include, but are not limited to, polyethylene glycol (PEG), copolymers of ethylene glycol or propylene glycol, carboxymethylcellulose, dextran, polyvinyl alcohol, polyvinyl pyrrolidone, poly-1, 3-dioxolane, poly-1,3,6-trioxane, ethylene/maleic anhydride copolymer, polyamino acids (either homopolymers or random copolymers), poly(n-vinyl pyrrolidone) polyethylene glycol, propropylene glycol homopolymers, prolypropylene oxide/ethylene oxide copolymers, polyoxyethylated polyols (e.g., glycerol), polyvinyl alcohol, and mixtures thereof.

Polyethylene glycol propionaldehyde has advantages in industrialization due to its stability in water. This polymer may be of any molecular weight, and may be branched or unbranched. The number of polymers attached to the antibody may vary, and if more than one polymers are attached, they can be the same or different molecules. In general, the number and/or type of polymers used for derivertization can be determined based on considerations including, but not limited to, the particular properties or functions of the antibody to be improved, when the antibody derivative is used in a defined therapy, etc.

In another embodiment, conjugates of an anti-IL-8 antibody of Disclosure C and nonproteinaceous moiety that may be selectively heated by exposure to radiation may be provided. In one embodiment, the nonproteinaceous moiety is, for example, a carbon nanotube (see, e.g., Kam et al., Proc. Natl. Acad. Sci. USA 102:11600-11605 (2005)). The radiation may be of any wavelength and includes, without being limited thereto, wavelengths that are harmless to humans but can heat the nonproteinaceous moiety to a temperature so as to kill cells proximal to the antibody-nonproteinaceous moiety.

B. Recombination Methods and Compositions

Anti-IL-8 antibodies of Disclosure C may be produced using recombinant methods and compositions, for example, as described in U.S. Pat. No. 4,816,567. One embodiment provides isolated nucleic acid(s) encoding an anti-IL-8 antibody which are presented as Disclosure C. Such nucleic acid(s) may encode an amino acid sequence comprising the VL of the antibody and/or an amino acid sequence comprising the VH of the antibody (e.g., the light and/or heavy chains of the antibody). In a further embodiment, one or more vectors (e.g., expression vectors) comprising such nucleic acid are provided. In one embodiment, a host cell comprising such nucleic acid(s) is provided. In one such embodiment, a host cell comprises (e.g., has been transformed with): (1) a vector comprising a nucleic acid that encodes the VL of the antibody and the VH of an antibody, or (2) a first vector comprising a nucleic acid that encodes the VL of an antibody and a second vector comprising a nucleic acid that encodes the VH of the antibody.

In one embodiment, the host is eukaryotic (e.g., a Chinese Hamster Ovary (CHO) cell or lymphoid cell (e.g., Y0, NS0, SP20 cell)).

In one embodiment, a method of producing an anti-IL-8 antibody of Disclosure C is provided, wherein the method comprises culturing a host cell comprising a nucleic acid encoding the anti-IL-8 antibody as provided above, under conditions suitable for expressing the antibody, and optionally recovering the antibody (e.g., from the host cell or host cell culture medium).

For recombinant production of an anti-IL-8 antibody, nucleic acid(s) encoding an antibody, for example, as described above, is isolated and inserted into one or more vectors for further cloning and/or expression in a host cell. Such nucleic acid(s) may be readily isolated and sequenced using conventional procedures (e.g., by using oligonucleotide probes that specifically bind to nucleic acids encoding the heavy and light chains of the antibody).

Suitable host cells for cloning or expression of antibody-encoding vectors include prokaryotic or eukaryotic cells described within the scope of the description of Disclosure C herein. For example, antibodies may be produced in bacteria, in particular, when glycosylation and Fc effector function are not needed. For expression of antibody fragments and polypeptides in bacteria, see for example, U.S. Pat. Nos. 5,648,237, 5,789,199, and 5,840,523 (See also Charlton, Methods in Molecular Biology, Vol. 248 (B.K.C. Lo, ed., Humana Press, Totowa, N. J., 2003), pp. 245-254, for expression of antibody fragments in *E. coli*). After expression, the antibody may be isolated from the bacterial cell paste in a soluble fraction and can be further purified.

In addition to prokaryotes, eukaryotic microbes such as filamentous fungi or yeast are suitable hosts for cloning or expression of antibody-encoding vectors, including fungi and yeast strains whose glycosylation pathways have been "humanized", which enable production of antibodies with a partially or fully human glycosylation pattern. See Gerngross, *Nat. Biotech.* 22:1409-1414 (2004), and Li et al., *Nat. Biotech.* 24:210-215 (2006).

Suitable host cells for the expression of a glycosylated antibody are also derived from multicellular organisms (invertebrates and vertebrates). Examples of invertebrate cells include plant and insect cells. Without particular limitations, baculovirus is used in conjunction with insect cells for transfection of *Spodoptera frugiperda* cells and numerous baculoviral strains have been identified.

Plant cell cultures can also be utilized as hosts. See U.S. Pat. Nos. 5,959,177, 6,040,498, 6,420,548, 7,125,978, and 6,417,429 (describing PLANTIBODIES™ technology for producing antibodies in transgenic plants).

Vertebrate cells may also be used as hosts. For example, mammalian cell lines that are adapted to grow in suspension are useful. Other examples of useful mammalian host cells are monkey kidney CV1 line transformed by SV40 (COS-7); human embryonic kidney line (293 cells as described in Graham et al., *J. Gen Virol.* 36:59 (1977)); baby hamster kidney cells (BHK); mouse sertoli cells (TM4 cells as described in Mather, *Biol. Reprod.* 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TM cells, as described in Mather et al., *Annals N.Y. Acad. Sci.* 383:44-68 (1982); MRCS cells; and FS4 cells.

Other useful mammalian host cell lines include Chinese hamster ovary (CHO) cells, including DHFR-CHO cells (Urlaub et al., *Proc. Natl. Acad. Sci. USA* 77:4216 (1980)); and myeloma cell lines such as Y0, NS0 and Sp20, but are not limited thereto. For a review of other mammalian host cell lines suitable for antibody production, see Yazaki and Wu, Methods in Molecular Biology, Vol. 248 (B.K.C. Lo, ed., Humana Press, Totowa, N.J.), pp. 255-268 (2003).

An antibody of Disclosure C produced by culturing such host cells as described above to carry nucleic acids that encode the antibody under conditions that are suitable for antibody expression may be isolated from inside or outside of the host cells (media, milk, etc.), and purified as a substantially pure homogeneous antibody. Isolation/purification methods that are generally used to purify polypeptides can be appropriately used to isolate and purify the antibody; however, the methods are not limited to the above example. The antibody can be appropriately separated and purified, for example, by appropriately selecting and combining column chromatography, filters, ultrafiltration, salting out, solvent precipitation, solvent extraction, distillation, immunoprecipitation, SDS-polyacrylamide gel electrophoresis, isoelectric focusing, dialysis, and recrystallization, without being limited thereto. Chromatography includes, but is not limited to, affinity chromatography, ion exchange chromatography, hydrophobic chromatography, gel filtration chromatography, reverse phase chromatography, and adsorption chromatography. Such chromatography can be performed using liquid chromatography, for example, HPLC and FPLC. Columns for use in affinity chromatography include, but are not limited to, Protein A column and Protein G column. Protein A columns include, but are not limited to, Hyper D, POROS, Sepharose F. F. (Pharmacia) and so on.

Focusing on the characteristics of anti-IL-8 antibodies such as increased extracellular matrix-binding activity and enhanced cellular uptake of the complex described above, Disclosure C provides methods for selecting antibodies with increased extracellular matrix-binding and antibodies with enhanced cellular uptake. In one embodiment, Disclosure C provides methods for producing an anti-IL-8 antibody comprising variable region whose binding activity to IL-8 is in an pH-dependent manner, which comprise the steps of: (a) assessing the binding between anti-IL-8 antibody and extracellular matrix; (b) selecting an anti-IL-8 antibody that strongly binds to extracellular matrix; (c) culturing a host that comprises a vector carrying a nucleic acid encoding the antibody; and (d) isolating the antibody from the culture medium.

Binding with extracellular matrix can be assessed by any methods without particular limitations, as long as they are known to those of ordinary skill in the art. For example, assays can be carried out using an ELISA system for detecting the binding between an antibody and extracellular matrix, where the antibody is added to an extracellular matrix-immobilized plate and a labeled antibody against the antibody is added thereto. Alternatively, such assays can be performed, for example, using an electrochemiluminescence (ECL) method in which a mixture of the antibody and a ruthenium antibody is added to an extracellular matrix-immobilized plate and the binding between the antibody and extracellular matrix is assessed based on the electrochemiluminescence of ruthenium.

The anti-IL-8 antibody being assessed for extracellular matrix binding in step (i) above may be the antibody by itself or in contact with IL-8. "Selecting an anti-IL-8 antibody that strongly binds to extracellular matrix" in step (ii) means that an anti-IL-8 antibody is selected based on the criterion that a value representing the binding between extracellular matrix and the anti-IL-8 antibody is higher than a value representing the binding between extracellular matrix and the control antibody in the assessment of extracellular matrix binding, and may be, for example, 2-fold, 3-fold, 4-fold, 5-fold, 6-fold, 7-fold, 8-fold, 9-fold, 10-fold, 20-fold, 50-fold, 100-fold, or more; however, the ratio is not particularly limited to the examples above. Other than the presence of IL-8, the conditions are preferably the same in the step of assessing the binding between an anti-IL-8 antibody and extracellular matrix. The control anti-IL-8 antibody for use in comparing several modified anti-IL-8 antibodies may be the unmodified anti-IL-8 antibody. In this case, the conditions are preferably the same other than the presence of IL-8. Specifically, in one embodiment, Disclosure C includes selecting an antibody with a higher value representing extracellular matrix binding from several anti-IL-8 antibodies that are not in contact with IL-8. In another embodiment, Disclosure C includes selecting an antibody with a higher value representing extracellular matrix binding from several anti-IL-8 antibodies that are in contact with IL-8. In an alternative embodiment, "selecting an anti-IL-8 antibody that strongly binds to extracellular matrix" in step (ii) means that an antibody may be selected based on the criterion that the binding between an antibody and extracellular matrix varies depending on the presence of IL-8, when assessing extracellular matrix binding. The ratio of a value representing the extracellular matrix binding of an anti-IL-8 antibody in contact with IL-8 to a value representing the extracellular matrix binding of an anti-IL-8 antibody not in contact with IL-8 may be, for example, 2 to 1000. Furthermore, the ratio between the values may be 2, 3, 4, 5, 6, 7, 8, 9, 10, 20, 50, 100, 200, 300, 400, 500, 600, 700, 800, 900, or 1000.

C. Assays

Anti-IL-8 antibodies provided within the scope of Disclosure C described herein can be identified, screened, or characterized in terms of their physical/chemical properties and/or biological activities by various methods known in the art.

1. Binding Assays and Other Assays

In one aspect, the antibodies of Disclosure C can be assessed for their antigen-binding activity by known methods, for example, ELISA, Western blotting, kinetic exclusion assay (KinExA™), and surface plasmon resonance using a device such as BIACORE (GE Healthcare).

In one embodiment, the binding affinity can be measured using BIACORE T200 (GE Healthcare) in the following manner. An appropriate amount of a trapping protein (for example, Protein A/G (PIERCE)) is immobilized onto a sensor chip CM4 (GE Healthcare) by the amine-coupling method, and an antibody of interest is allowed to be captured. Then, a diluted antigen solution and running buffer (as a reference solution: for example, 0.05% tween 20, 20 mM ACES, 150 mM NaCl, pH 7.4) are injected to interact antigen molecules with the antibody trapped on the sensor chip. The sensor chip is regenerated using 10 mM glycine HCl solution (pH 1.5). Measurements are performed at a pre-determined temperature (for example, 37° C., 25° C., or 20° C.). The association rate constant kon (1/Ms) and dissociation rate constant koff (1/s), both of which are kinetic parameters, are calculated from sensorgrams obtained by measurement. The KD (M) of each antibody for the antigen is calculated based on these constants. Each parameter is calculated using the BIACORE T200 Evaluation Software (GE Healthcare).

In one embodiment, IL-8 can be quantitated as described below. An anti-human IL-8 antibody comprising the mouse IgG constant region is immobilized onto a plate. A solution comprising IL-8 bound to a humanized anti-IL-8 antibody, which does not compete with the above-described anti-human IL-8 antibody, is aliquoted to the immobilized plate. After stirring, a biotinylated anti-human Ig κ k light chain antibody is added and allowed to react for a certain period of time. Then, SULFO-Tag-labeled streptavidin is further added and allowed to react for a certain period of time. Then, assay buffer is added and immediately measurement is performed with SECTOR Imager 2400 (Meso Scale Discovery).

2. Activity Assays

In one aspect, assays are provided to identify an anti-IL-8 antibody having a biological activity. The biological activity includes, for example, IL-8-neutralizing activity and the activity of blocking IL-8 signals. The Disclosure C also provides antibodies with such biological activity in vivo and/or ex vivo.

In one embodiment, the method for determining the level of IL-8 neutralization is not particularly limited and it can also be determined by the methods described below. PathHunter™ CHO-K1 CXCR2 β-Arrestin Cell Line (DiscoveRx, Cat. #93-0202C2) is an artificial cell line created to express human CXCR2 known as a human IL-8 receptor and emit chemiluminescence when receiving signals by human IL-8. When human IL-8 is added to a culture medium of the cells, chemiluminescence is emitted from the cells in a manner that depends on the concentration of added human IL-8. When human IL-8 is added in combination with an anti-human IL-8 antibody to the culture medium, the chemiluminescence of the cells is reduced or undetectable as compared to when the antibody is not added, since the anti-human IL-8 antibody can block the IL-8 signal transduction. Specifically, the stronger the human IL-8-neutralizing activity of the antibody is, the weaker the level of chemiluminescence is; and the weaker the human IL-8-neutralizing activity of the antibody is, the greater the level of chemiluminescence is. Thus, the human IL-8-neutralizing activity of the anti-human IL-8 antibody can be assessed by examining the difference described above.

D. Pharmaceutical Formulations

Pharmaceutical formulations comprising an anti-IL-8 antibody as described within the scope of the description Disclosure C herein may be prepared by mixing an anti-IL-8 antibody having the desired degree of purity with one or more optional pharmaceutically acceptable carriers (see, e.g., Remington's Pharmaceutical Sciences 16th edition, Osol, A. Ed. (1980)) in the form of lyophilized formulations or aqueous solution formulations.

Pharmaceutically acceptable carriers are generally non-toxic to recipients at the dosages and concentrations employed, and include without being limited to buffers such as phosphate, citrate, histidine, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular-weight (less than about 10 residues) polypeptides; proteins such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™, or polyethylene glycol (PEG).

Exemplary pharmaceutically acceptable carriers herein further include interstitial drug dispersion agents such as soluble hyaluronidase glycoproteins (sHASEGP), for example, human soluble PH-20 hyaluronidase glycoproteins, such as rHuPH20 (HYLENEX™, Baxter International, Inc.). Certain exemplary sHASEGPs and methods of use, including rHuPH20, are described in US Appl. Publ. Nos. 2005/0260186 and 2006/0104968. In one aspect, a sHASEGP is combined with one or more glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908; and the WO2006/044908 formulations include a histidine-acetate buffer.

The formulation within the scope of Disclosure C herein may also contain more than one active ingredients as necessary for the particular indication being treated, preferably those with complementary activities that do not adversely affect each other. Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semipermeable matrices of solid hydrophobic polymers containing the anti-IL8 antibody of the Disclosure C, in which the matrices are in the form of shaped articles, for example, films or microcapsules.

The formulations to be used for in vivo administration are generally sterile. Sterility may be readily accomplished, for example, by filtration through sterile filtration membranes.

E. Therapeutic Methods and Compositions

In some embodiments, the anti-IL-8 antibodies provided according to Disclosure C are used in therapeutic methods.

In one aspect, an anti-IL-8 antibody for use as a pharmaceutical composition is provided. In an alternative aspect, an anti-IL-8 antibody for use in treating a disease where IL-8 is present in an excessive amount is provided. In one embodiment, an anti-IL-8 antibody for use in methods for treating a disease where IL-8 is present in an excessive amount is provided. In one embodiment, Disclosure C provides methods for treating an individual with a disease where IL-8 is present in an excessive amount (for example, a disease caused by the presence of excessive IL-8), which comprises administering an effective amount of an anti-IL-8 antibody to the individual. In another embodiment, Disclosure C provides anti-IL-8 antibodies for use in such methods. In one embodiment, Disclosure C relates to a pharmaceutical composition comprising an effective amount of an anti-IL-8 antibody, which is used to treat a disease where IL-8 is present in an excessive amount. In one embodiment, Disclosure C relates to the use of an anti-IL-8 antibody in producing a pharmaceutical composition for a disease where IL-8 is present in an excessive amount. In one embodiment, Disclosure C relates the use of an effective amount of an anti-IL-8 antibody in treating a disease where IL-8 is present in an excessive amount. Diseases where IL-8 is present in an excessive amount include, but are not limited to, inflammatory skin diseases such as inflammatory keratosis (psoriasis, etc.), atopic dermatitis, and contact dermatitis; autoimmune diseases such as chronic inflammatory diseases including chronic rheumatoid arthritis, systemic lupus erythematosus (SLE), and Behcet disease; inflammatory bowel diseases such as Crohn's disease and ulcerative colitis; inflammatory liver diseases such as hepatitis B, hepatitis C, alcoholic hepatitis, and allergic hepatitis induced by drugs; inflammatory kidney diseases such as glomerular nephritis; inflammatory respiratory diseases such as bronchitis and asthma; chronic inflammatory vascular disease such as atherosclerosis; multiple sclerosis; oral ulcer; chorditis; inflammation induced by an artificial organ/artificial blood vessel; a malignant tumor such as ovarian cancer, lung cancer, prostate cancer, stomach cancer, breast cancer, melanoma, head and neck cancer, and kidney cancer; sepsis caused by infection; cystic fibrosis; pulmonary fibrosis; and acute lung injury.

In an alternative embodiment, Disclosure C provides an anti-IL-8 antibody for use in suppressing the accumulation of IL-8 with biological activity. "Suppressing the accumulation of IL-8" may be achieved by preventing the amount of pre-existing IL-8 in vivo from increasing or by reducing the amount of pre-existing IL-8 in vivo. In one embodiment, the Disclosure C provides an anti-IL-8 antibody for suppressing the accumulation of IL-8 in an individual to suppress the accumulation of IL-8 with biological activity. Here, "IL-8 present in vivo" may refer to IL-8 complexed with anti-IL-8 antibody or free IL-8; alternatively, it may refer to total IL-8 as its sum. Herein, "present in vivo" may mean "secreted to the outside of the cells in vivo." In one embodiment, Disclosure C provides a method for suppressing the accumulation of IL-8 with biological activity, which comprises the step of administering an effective amount of an anti-IL-8 antibody. In one embodiment, Disclosure C relates to a pharmaceutical composition for suppressing the accumulation of IL-8 with biological activity, which comprises an effective amount of an anti-IL-8 antibody. In one embodiment, Disclosure C relates to the use of an anti-IL-8 antibody in producing a pharmaceutical composition for suppressing the accumulation of IL-8 with biological activity. In one embodiment, Disclosure C relates to the use of an effective amount of an anti-IL-8 antibody in suppressing the accumulation of IL-8 with biological activity. In one embodiment, an anti-IL-8 antibody of Disclosure C suppresses the accumulation of IL-8 as compared to an anti-IL-8 antibody that does not have pH-dependent binding activity. In the above-described embodiments, the "individual" is preferably a human.

In an alternative embodiment, Disclosure C provides an anti-IL-8 antibody for use in inhibiting angiogenesis (e.g., neoangiogenesis). In one embodiment, Disclosure C provides a method for inhibiting neoangiogenesis in an individual which comprises administering an effective amount of an anti-IL-8 antibody to the individual, and also provides an anti-IL-8 antibody for use in the method. In one embodiment, Disclosure C relates to a pharmaceutical composition for inhibiting neoangiogenesis which comprises an effective amount of an anti-IL-8 antibody. In one embodiment, Disclosure C relates to the use of an anti-IL-8 antibody in producing a pharmaceutical composition for inhibiting neoangiogenesis. In one embodiment, Disclosure C relates to the use of an effective amount of an anti-IL-8 antibody in inhibiting neoangiogenesis. In the above-described embodiments, the "individual" is preferably a human.

In an alternative aspect, Disclosure C provides an anti-IL-8 antibody for use in inhibiting the facilitation of neutrophil migration. In one embodiment, Disclosure C provides a methods for inhibiting the facilitation of neutrophil migration in an individual, which comprises administering an effective amount of an anti-IL-8 antibody to the individual; and also provides an anti-IL-8 antibody for use in the method. In one embodiment, Disclosure C relates to pharmaceutical compositions for inhibiting facilitation of neutrophil migration in an individual, which comprise an effective amount of an anti-IL-8 antibody. In one embodiment, Disclosure C relates to the use of an anti-IL-8 antibody in producing a pharmaceutical composition for inhibiting facilitation of neutrophil migration in an individual. In one embodiment, Disclosure C relates to the use of an effective amount of an anti-IL-8 antibody in inhibiting facilitation of neutrophil migration in an individual. In the above-described embodiments, the "individual" is preferably a human.

In an alternative embodiment, Disclosure C provides a pharmaceutical composition comprising an anti-IL-8 antibody provided herein for example, for use in any of the above therapeutic methods. In one embodiment, a pharmaceutical composition comprises an anti-IL-8 antibodies provided in Disclosure C and a pharmaceutically acceptable carrier.

An antibody of Disclosure C can be used either alone or in combination with other agents in a therapy. For instance, an antibody of Disclosure C may be co-administered with at least one additional therapeutic agent.

An antibody of Disclosure C (and any additional therapeutic agent) can be administered by any suitable means, including parenteral, intrapulmonary, and intranasal, and if desired for local treatment, intralesional administration. Parenteral infusions include intramuscular, intravenous, intraarterial, intraperitoneal, or subcutaneous administration. Dosing can be by any suitable route, for example, by injections such as intravenous or subcutaneous injections, depending in part on whether the administration is brief or chronic. Various dosing schedules include, without being limited to, single or multiple administrations over various time-points, bolus administration, and pulse infusion may be contemplated herein.

Preferably an antibody of Disclosure C is formulated, dosed, and administered in a fashion consistent with good medical practice. Factors for consideration in this context include the particular disorder being treated, the particular mammal being treated, the clinical condition of the individual patient, the cause of the disorder, the site of delivery of the pharmaceutical composition, the method of administration, the scheduling of administration, and other factors known to medical practitioners. The antibody need not be, but is optionally formulated with one or more agents currently used to prevent or treat the disorder in question.

The effective amount of such other agents depends on the amount of antibody present in the formulation, the type of disorder or treatment, and other factors discussed above. These may be generally used at the same dosages and via the same administration routes described within the scope of the description of Disclosure C herein, or from 1 to 99% of the dosages described within the scope of the description of Disclosure C herein, or in any dosage and by any route that is empirically/clinically determined to be appropriate.

For the prevention or treatment of a disease, the appropriate dose of an antibody of Disclosure C (when used alone or in combination with one or more other additional therapeutic agents) depends on the type of disease to be treated, the type of antibody, the severity and course of the disease, whether the antibody variant is administered for preventive or therapeutic purposes, previous therapy, the patient's clinical history and response to the antibody, and discretion of the attending physician. The antibody is suitably administered to the patient at one time or over a series of treatments. Depending on the type and severity of the disease, about 1 µg/kg to 15 mg/kg (for example, 0.1 mg/kg to 10 mg/kg) of an antibody can be an initial candidate dose for administration to the patient, for example, by a single administration or several separate administrations, or by continuous infusion. One typical daily dose may range from about 1 mg/kg to 100 mg/kg or more, depending on the factors described above. For repeated administrations over several days or longer, depending on the condition, the treatment may be generally sustained until a desired suppressive effect of disease symptoms is seen. A typical dose of an antibody may fall, for example, in the range from about 0.05 mg/kg to about 10 mg/kg. Thus, one or more doses of, for example, about 0.5 mg/kg, for example, 2.0 mg/kg, for example, 4.0 mg/kg, or for example, 10 mg/kg (or any combination thereof) may be administered to the patient. Such doses may be administered intermittently, for example, every week or every three weeks (for example, in such a manner that the patient receives from about two to about twenty doses, or about six doses of the antibody). It is possible to administer an initial higher loading dose, followed by one or more lower doses; however, other dosage regimens may be useful. The progress of this therapy can be easily monitored by conventional techniques and assays.

F. Articles of Manufacture

In another aspect of Disclosure C, the disclosure provides articles of manufacture comprising materials useful for the treatment, prevention and/or diagnosis of a disorder described above. Such an article of manufacture includes a container and a label or package insert on or associated with the container. Suitable containers include, for example, bottles, vials, and intravenous solution bags. The containers may be formed from various materials such as glass or plastic. Such a container holds a composition which is by itself or combined with another composition effective for treating, preventing and/or diagnosing the condition and may have a sterile access port (for example, the container may be an intravenous solution bag or a vial having a stopper pierceable by a hypodermic injection needle). At least one active ingredient in the composition is an antibody of Disclosure C. The label or package insert indicates that the composition is used for treating the condition of choice.

Moreover, the article of manufacture may include: (a) a first container that comprises a composition comprising an antibody of Disclosure C; and (b) a second container that comprises a composition comprising an additional cytotoxic agent or a different therapeutic agent. The article of manufacture in the embodiments of Disclosure C may further include a package insert indicating that the compositions can be used to treat a particular condition. Alternatively or additionally, the article of manufacture may further include, for example, a second (or third) container that comprises a pharmaceutically acceptable buffer such as bacteriostatic water for injection (BWFI), phosphate-buffered saline, Ringer's solution and dextrose solution. The article of manufacture may further include other materials desirable from a commercial perspective or a user's standpoint, including other buffers, diluents, filters, needles, and syringes.

Those of ordinary skill in the art can appreciate based on the technological common knowledge in the art, that the Disclosure C also includes all combinations of the whole or part of one or more of the entire embodiments described herein, except where there is a technological inconsistency. Disclosure A, B, or C All technical background documents cited herein are incorporated herein by reference.

As used herein, the phrase "and/or" is understood to include the meaning of combinations of terms before and after the phrase "and/or", which include all combinations of the terms appropriately linked by the phrase.

While various elements are described herein with terms such as first, second, third, fourth, etc., it is appreciated that the elements are not limited by such terms. These terms are used only to distinguish an element from other elements, and it is appreciated that, for example, a first element could be termed a second element, and similarly, a second element could be termed a first element, without departing from the scope of Disclosures A, B, and C.

Unless explicitly stated otherwise or unless there are inconsistencies in the context, any terms expressed in the singular form herein are meant to also include the plural form and any terms expressed in the plural form herein are meant to also include the singular form.

The terminology used herein is for the purpose of describing particular embodiments only and is not intended to limit the disclosure. Unless otherwise defined differently, all terms (including technical and scientific terms) used herein are interpreted to have the same meaning as commonly understood by those of ordinary skill in the art to which Disclosures A, B, and C pertain, and will not be interpreted in an idealized or overly formal sense.

As used herein, the term "comprises" is intended to specify the presence of described items (members, steps, elements, numbers, etc.), unless the context clearly indicates otherwise; and the term does not preclude the presence of other items (members, steps, elements, numbers, etc.).

Embodiments of the Disclosures A, B, and C are described with reference to schematic illustrations, which may be exaggerated for clarity.

Unless there are inconsistencies in the context, numerical values used herein are understood to be values that represent a certain range based on the common technical knowledge of those of ordinary skill in the art. For example, the expression "1 mg" is understood to be described as "about 1 mg" with certain variations. For example, the expression "1 to 5 items" is understood to be described specifically and individually as "1 item, 2 items, 3 items, 4 items, 5 items", unless there are inconsistencies in the context.

EXAMPLES

Hereinbelow, Disclosures A, B, and C will be specifically described by Examples 1 to 4 and 21 to 23, Examples 5 to 7, 19 and 20, and Examples 8 to 19, respectively, but they are not to be construed as being limited thereto. It is understood that various other embodiments may be practiced, given the general description provided above.

Example 1

Production of pH-Dependent Human IL-6 Receptor-Binding Human Antibodies with Increased pI Fv4-IgG1 disclosed in WO2009/125825 is an antibody that binds to the human IL-6 receptor in a pH-dependent manner, and comprises VH3-IgG1 (SEQ ID NO:24) as the heavy chain and VL3-CK (SEQ ID NO:32) as the light chain. To increase the pI of Fv4-IgG1, the variable region of Fv4-IgG1 was introduced with amino acid substitutions that decrease the number of negatively charged amino acids (such as aspartic acid and glutamic acid), while increasing the positively charged amino acids (such as arginine and lysine). Specifically, VH3(High_pI)-IgG1 (SEQ ID NO:25) was produced as a heavy chain with increased pI by substituting glutamic acid at position 16 with glutamine, glutamic acid at position 43 with arginine, glutamine at position 64 with lysine, and glutamic acid at position 105 with glutamine, according to Kabat numbering, in the heavy chain VH3-IgG1. Similarly, VL3(High_pI)-CK (SEQ ID NO:33) was produced as a light chain with increased pI by substituting serine at position 18 with arginine, glutamine at position 24 with arginine, glutamic acid at position 45 with lysine, glutamic acid at position 79 with glutamine, and glutamic acid at position 107 with lysine, according to Kabat numbering, in the light chain VL3-CK. When introducing the substitution at position 79 of VL3-CK, modifications that involve substituting alanine at position 80 with proline and alanine at position 83 with isoleucine were simultaneously introduced, although not with the aim to increase the pI.

The following antibodies were produced by the method of Reference Example 2: (a) Low_pI-IgG1 comprising VH3-IgG1 as the heavy chain and VL3-CK as the light chain; (b) Middle_pI-IgG1 comprising VH3-IgG1 as the heavy chain and VL3(High_pI)-CK as the light chain; and (c) High_pI-IgG1 comprising VH3(High_pI)-IgG1 as the heavy chain and VL3(High_pI)-CK as the light chain.

Next, the theoretical pI for each of the produced antibodies was calculated using GENETYX-SV/RC Ver 9.1.0 (GENETYX CORPORATION) using methods known in the art (see, e.g., Skoog et al., *Trends Analyt. Chem.* 5(4): 82-83 (1986)). The side chains of all cysteines in the antibody molecule were assumed to form disulfide bonds, and the contribution of cysteine side chains to pKa was excluded from the calculation.

The calculated theoretical pI values are shown in Table 3. While the theoretical pI of Low_pI-IgG1 was 6.39, those of Middle_pI-IgG1 and High_pI-IgG1 were 8.70 and 9.30, respectively, showing that the theoretical pI values increased in a stepwise manner.

WO2011/122011 discloses Fv4-IgG1-F11 (hereinafter, referred to as Low_pI-F11) and Fv4-IgG1-F939 (hereinafter, referred to as Low_pI-F939) whose FcRn-mediated uptake into cells has been enhanced by introducing amino acid substitutions into the Fc region of Fv4-IgG1 and conferring FcRn-binding ability under neutral pH conditions. Furthermore, WO2013/125667 discloses Fv4-IgG1-F1180 (hereinafter, referred to as Low_pI-F1180) whose FcγR-mediated uptake into cells has been enhanced by introducing amino acid substitutions into the Fc region of Fv4-IgG1 to increase its FcγR-binding ability under neutral pH conditions. Simultaneously, amino acid modification for enhancing the plasma retention of the antibody by increasing its FcRn binding under the acidic pH condition in the endosomes were introduced into Fv4-IgG1-F1180. The antibodies shown below were produced by increasing the pI of antibodies containing these novel Fc region variants.

Specifically, VH3-IgG1-F11 (SEQ ID NO:30) and VH3-IgG1-F939 (SEQ ID NO:26) in WO2011/122011, and VH3-IgG1-F1180 (SEQ ID NO:28) in WO2013/125667 were each subjected to substitutions of glutamic acid at position 16 with glutamine, glutamic acid at position 43 with arginine, glutamine at position 64 with lysine, and glutamic acid at position 105 with glutamine, according to Kabat numbering, to produce VH3(High_pI)-F11 (SEQ ID NO:31), VH3(High_pI)-F939 (SEQ ID NO:27), and VH3(High_pI)-F1180 (SEQ ID NO:29), respectively, as heavy chains with increased pI.

The following antibodies were produced by the method of Reference Example 2 using these heavy chains: (1) Low_pI-F939 comprising VH3-IgG1-F939 as the heavy chain and VL3-CK as the light chain; (2) Middle_pI-F939 comprising VH3(High_pI)-F939 as the heavy chain and VL3-CK as the light chain; (3) High_pI-F939 comprising VH3(High_pI)-F939 as the heavy chain and VL3(High_pI)-CK as the light chain; (4) Low_pI-F1180 comprising VH3-IgG1-F1180 as the heavy chain and VL3-CK as the light chain; (5) Middle_pI-F1180 comprising VH3-IgG1-F1180 as the heavy chain and VL3(High_pI)-CK as the light chain; (6) High_pI-F1180 comprising VH3(High_pI)-F1180 as the heavy chain and VL3(High_pI)-CK as the light chain; (7) Low_pI-F11 comprising VH3-IgG1-F11 as the heavy chain and VL3-CK as the light chain; and (8) High_pI-F11 comprising VH3(High_pI)-F11 as the heavy chain and VL3(High_pI)-CK as the light chain.

Next, the theoretical pI for each of the produced antibodies was calculated using GENETYX-SV/RC Ver 9.1.0 (GENETYX CORPORATION) by a method similar to that described previously. The calculated theoretical pI values are shown in Table 3. In all novel Fc region variant-containing antibodies, the theoretical pI values increased in a stepwise manner in the order of Low_pI, Middle_pI, and High_pI.

TABLE 3

| Antibody Name | Theoretical pI |
| --- | --- |
| Low_pI-IgG1 | 6.39 |
| Middle_pI-IgG1 | 8.70 |
| High_pI-IgG1 | 9.30 |
| Low_pI-F939 | 6.67 |

TABLE 3-continued

| Antibody Name | Theoretical pI |
| --- | --- |
| Middle_pI-F939 | 8.70 |
| High_pI-F939 | 9.42 |
| Low_pI-F1180 | 6.39 |
| Middle_pI-F1180 | 8.70 |
| High_pI-F1180 | 9.29 |
| Low_pI-F11 | 6.39 |
| High_pI-F11 | 9.28 |

Example 2

Antigen Eliminating Effects of Antibodies with Increased pI that Show pH-Dependent Binding (2-1) In Vivo Assay of pI-Adjusted pH-Dependent Human IL-6 Receptor-Binding Antibodies As shown below, in vivo assays were performed using the various pH-dependent human IL-6 receptor-binding antibodies produced in Example 1: Low_pI-IgG1, High_pI-IgG1, Low_pI-F939, Middle_pI-F939, High_pI-F939, Low_pI-F1180, Middle_pI-F1180, and High_pI-F1180.

Soluble human IL-6 receptor (also called "hsIL-6R") prepared by the method of Reference Example 3, the anti-human IL-6 receptor antibody, and human immunoglobulin preparation Sanglopor were administered simultaneously to human FcRn transgenic mice (B6.mFcRn−/−.hFcRn Tg line 32+/+ mouse, Jackson Laboratories; Methods Mol. Biol. 602: 93-104 (2010)), and the subsequent in vivo kinetics of the soluble human IL-6 receptor were evaluated. A mixed solution containing the soluble human IL-6 receptor, the anti-human IL-6 receptor antibody, and Sanglopor (at concentrations of 5 µg/mL, 0.1 mg/mL, and 100 mg/mL, respectively) was administered once at 10 mL/kg through the tail vein. Since the anti-human IL-6 receptor antibody was present in sufficient excess of the soluble human IL-6 receptor, almost all of the soluble human IL-6 receptor was assumed to be bound by the antibody. Blood was collected 15 minutes, seven hours, one day, two days, three days, and seven days after the administration. The collected blood was immediately subjected to centrifugation at 4° C. and 15,000 rpm for 15 minutes to obtain the plasma. The separated plasma was stored in a freezer set to −20° C. or below until measurements were taken.

(2-2) Measurement of the Soluble Human IL-6 Receptor Concentration in Plasma by the Electrochemiluminescence Method The soluble human IL-6 receptor concentration in mouse plasma was measured by the electrochemiluminescence method. Samples of soluble human IL-6 receptor adjusted to concentrations of 250, 125, 62.5, 31.25, 15.61, 7.81, or 3.90 pg/mL for the calibration curve, and mouse plasma assay samples diluted 50-fold or more were prepared, respectively. The samples were mixed with a monoclonal anti-human IL-6R antibody (R&D) ruthenium-labeled with SULFO-TAG NHS Ester (Meso Scale Discovery), a biotinylated anti-human IL-6R Antibody (R&D), and Tocilizumab (CAS number: 375823-41-9) which is a human IL-6 receptor-binding antibody, and then they were allowed to react overnight at 37° C. The final concentration of Tocilizumab was adjusted to 333 µg/mL. Then, the reaction solutions were dispensed into a Streptavidin Gold Multi-ARRAY Plate (Meso Scale Discovery). After another hour of reaction at room temperature, the reaction solution was washed. Then, immediately after Read Buffer T(×4) (Meso Scale Discovery) was dispensed into the plate, measurement was carried out using the SECTOR Imager 2400 (Meso Scale Discovery). The soluble human IL-6 receptor concentration was calculated based on the response in the calibration curve using the analytical software, SOFTmax PRO (Molecular Devices).

Figure 1:
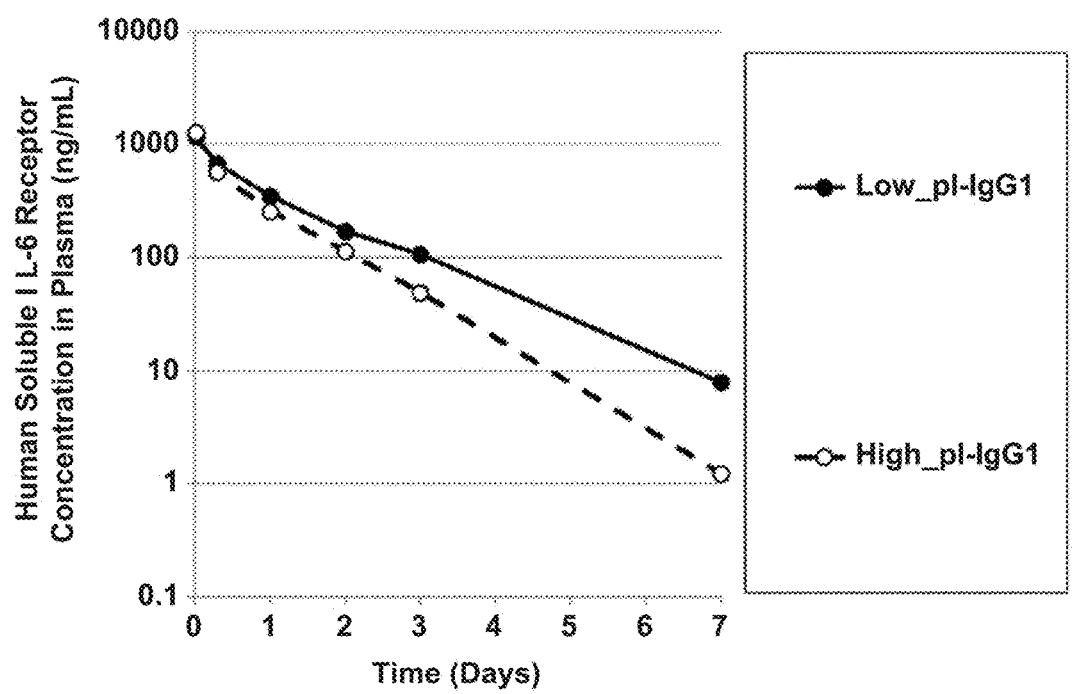
Figure 2:
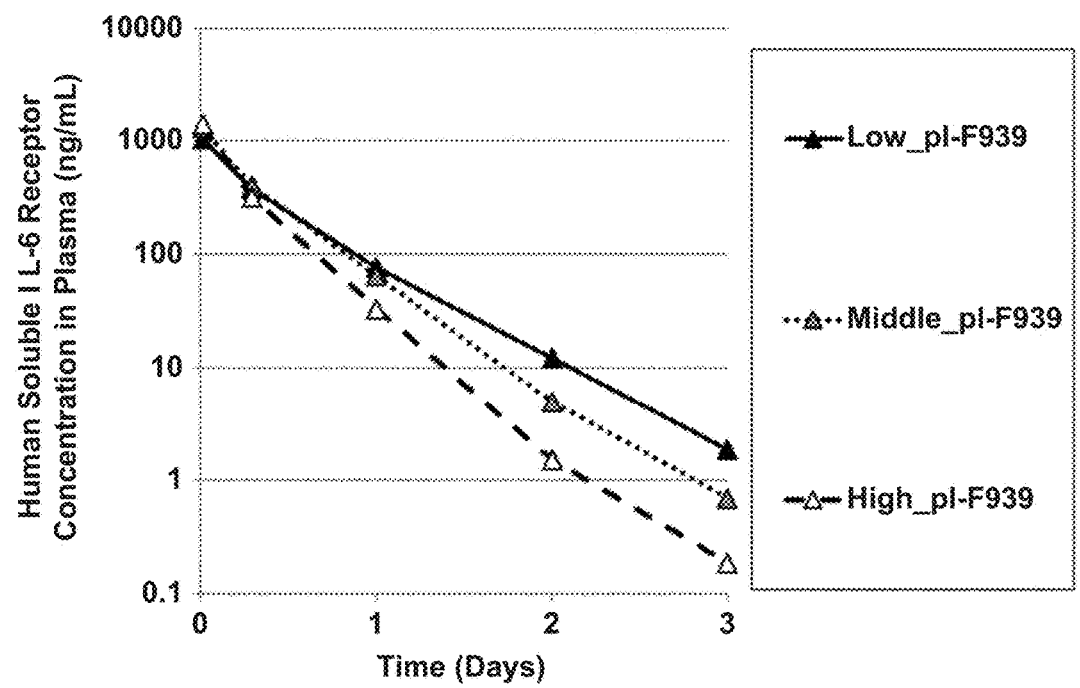
Figure 3:
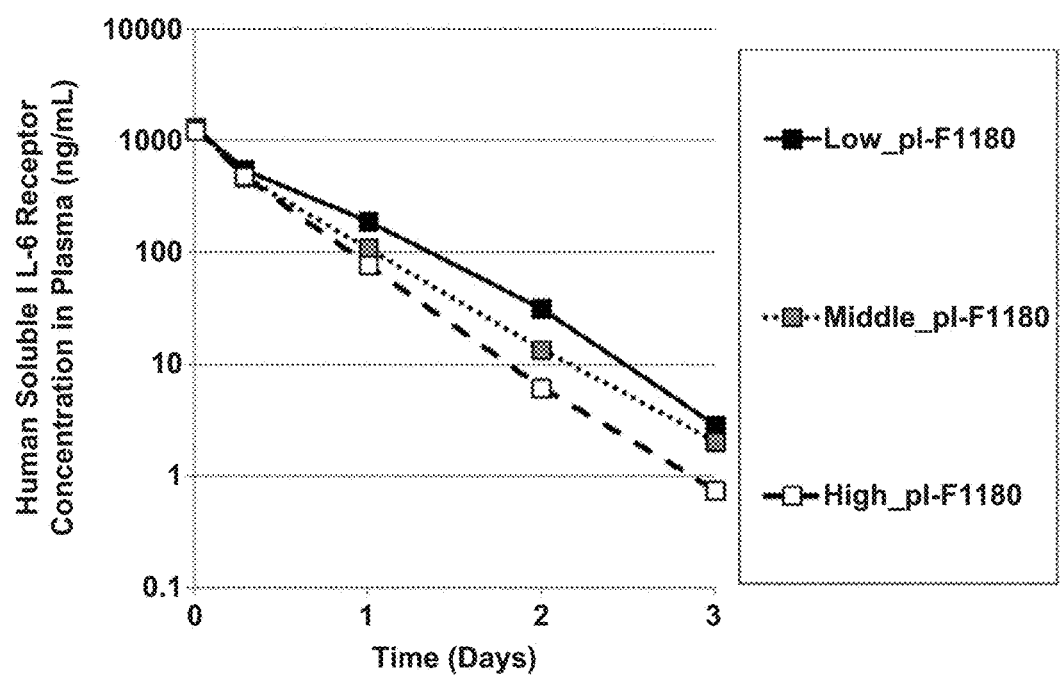

The observed changes in the concentration of the soluble human IL-6 receptor in the plasma of human FcRn transgenic mice after the intravenous administration are shown in FIGS. 1, 2, and 3. FIG. 1 shows the effect of enhancing antigen elimination where the pI of the variable region was increased in the case of a native IgG1 constant region. FIG. 2 shows the effect of enhancing antigen elimination where the pI of the variable region was increased in an antibody that has been conferred with the ability to bind to FcRn under a neutral pH condition (F939). FIG. 3 shows the effect of enhancing antigen elimination where the pI of the variable region was increased in an antibody whose FcγR-binding ability under a neutral pH condition has been enhanced (F1180).

In all cases, it was shown that by increasing the pI of the antibodies, the rate of antigen elimination by the pH-dependent binding antibodies can be accelerated. It was also shown that by further conferring an increase in the binding ability toward FcRn or FcγR under the neutral pH conditions, the rate of antigen elimination can be further accelerated as compared to when only the pI was increased in the pH-dependent binding antibodies (comparison of FIG. 1 to FIGS. 2 and 3).

(2-3) In Vivo Infusion Assay of pI-Adjusted pH-Dependent Human IL-6 Receptor-Binding Antibodies An in vivo assay was conducted below using the various pH-dependent human IL-6 receptor-binding antibodies produced in Example 1: Low_pI-IgG1, High_pI-IgG1, Low_pI-F11, and High_pI-F11.

An infusion pump (MINI-OSMOTIC PUMP MODEL 2004; alzet) containing a soluble human IL-6 receptor was implanted subcutaneously on the back of human FcRn transgenic mice (B6.mFcRn−/−.hFcRn Tg line 32+/+ mouse, Jackson Laboratories; *Methods Mol. Biol.* 602:93-104 (2010)) to produce model animals whose plasma concentration of the soluble human IL-6 receptor was kept constant. Anti-human IL-6 receptor antibodies were administered to the model animals, and the in vivo kinetics of the antibodies after the administration were assessed.

Specifically, a monoclonal anti-mouse CD4 antibody obtained by a method known in the art was administered once at 20 mg/kg into the tail vein to suppress the production of neutralizing antibodies potentially producible by the mouse itself against the soluble human IL-6 receptor. Then, an infusion pump containing 92.8 μg/ml of the soluble human IL-6 receptor was implanted subcutaneously on the back of the mice. Three days after implantation of the infusion pump, anti-human IL-6 receptor antibodies were administered once at 1 mg/kg into the tail vein. Blood was collected from the mice 15 minutes, seven hours, one day, two days, three or four days, six or seven days, 13 or 14 days, 20 or 21 days, and 27 or 28 days after the administration of the anti-human IL-6 receptor antibodies. The collected blood was immediately centrifuged at 15,000 rpm and 4° C. for 15 minutes to obtain plasma. The separated plasma was stored in a freezer at −20° C. or below until measurements were taken.

(2-4) Measurement of the Plasma hsIL-6R Concentration by the Electrochemiluminescence Method The hsIL-6R concentration in mouse plasma was measured by the electrochemiluminescence method. Samples of hsIL-6R adjusted to 250, 125, 62.5, 31.25, 15.61, 7.81, or 3.90 pg/mL for the calibration curve and mouse plasma assay samples diluted 50-fold or more were mixed with a monoclonal anti-human IL-6R antibody (R&D) ruthenium-labeled with SULFO-TAG NHS Ester (Meso Scale Discovery), a biotinylated anti-human IL-6R Antibody (R&D), and Tocilizumab, and they were allowed to react overnight at 37° C. The final concentration of Tocilizumab was adjusted to 333 μg/mL. Then, the reaction solutions were dispensed into a Streptavidin Gold Multi-ARRAY Plate (Meso Scale Discovery). After another hour of reaction at room temperature, the reaction solution was washed. Then, immediately after Read Buffer T(×4) (Meso Scale Discovery) was dispensed into the plate, measurement was carried out using the SECTOR Imager 2400 (Meso Scale Discovery). The hsIL-6R concentration was calculated based on the response in the calibration curve using the analytical software SOFT max PRO (Molecular Devices).

Figure 4:
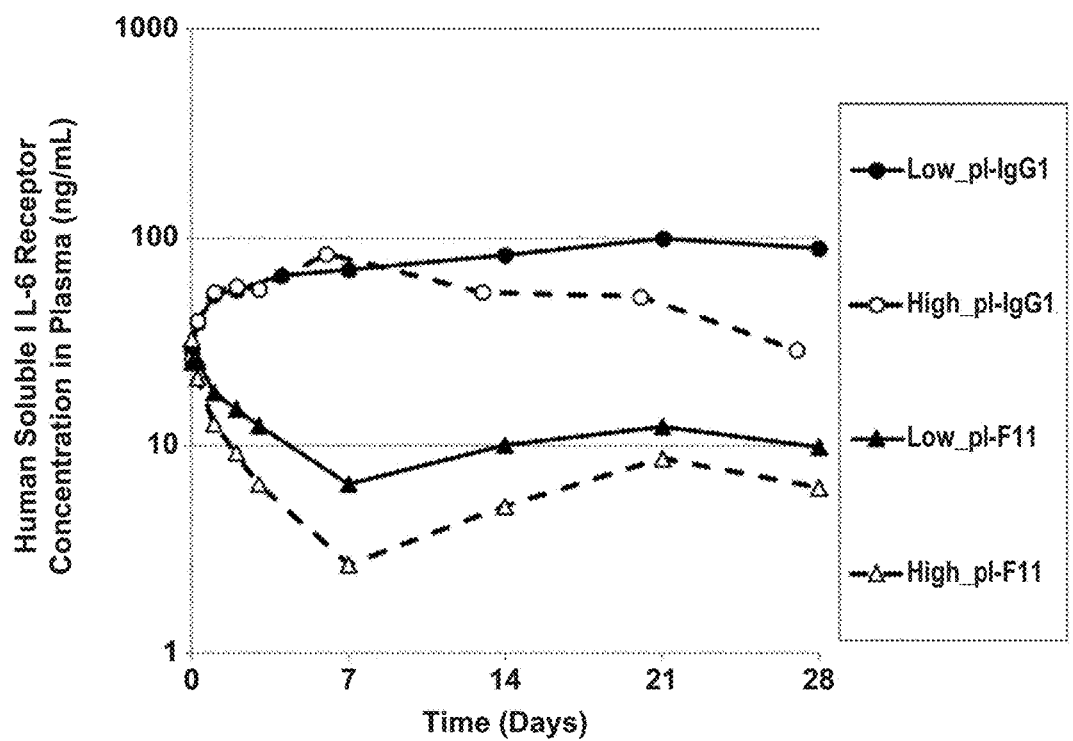

Changes in the measured human IL-6 receptor concentration are shown in FIG. 4. As for both the antibody whose Fc region is that of the native IgG1 (High_pI-IgG1) and the antibody which contains the novel Fc region variant with enhanced binding toward FcRn under the neutral pH conditions (High_pI-F11), the plasma concentration of the soluble human IL-6 receptor was decreased in the case a high-pI antibody (also called "High_pI") is administered as compared to the case a low-pI antibody (also called "Low_pI") is administered.

Without being bound by a particular theory, results obtained from these experiments can also be explained as follows: when the Fc region of the administered antibody is that of a native IgG antibody, uptake into the cell is thought to take place mainly by non-specific uptake (pinocytosis). Here, since the cell membrane is negatively charged, the higher the pI of the administered antibody-antigen complex is (i.e., the charge of the molecule as a whole is inclined toward positive charge), the more readily the complex may approach the cell membrane, and the easier the nonspecific uptake may take place. When an antibody with increased pI forms a complex with an antigen, that complex as a whole also has an increased pI in comparison to a complex formed between the original antibody and the antigen; therefore, uptake into cells may be increased. Therefore, by increasing the pI of an antibody that shows pH-dependent antigen binding, the speed or rate of antigen elimination from the plasma can be further accelerated, and the antigen concentration in the plasma can be maintained at a lower level.

In these Examples, increase of the pI of the antibody was accomplished by introducing amino acid substitutions that decrease the number of negatively charged amino acids and/or increase the number of positively charged amino acids that may be exposed on the surface of the antibody molecule in the antibody variable region. Those of ordinary skill in the art will understand that effects obtained by such pI increase do not depend primarily (or substantially) on the type of the target antigen or the amino acid sequence that constitutes the antibody, but can be expected to depend on the pI. For example, WO2007/114319 and WO2009/041643 describe the following matters in general terms.

Since the molecular weight of an IgG antibody is sufficiently large, its major metabolic pathway does not involve renal excretion. IgG antibodies that have Fc are known to have long half-lives since they are recycled by the salvage pathway of FcRn expressed in cells including the endothelial cells of blood vessels, and IgG is considered to be mainly metabolized in endothelial cells. More specifically, it is thought that IgGs that are non-specifically taken up into endothelial cells are recycled by binding to FcRn, and the molecules that cannot bind FcRn are metabolized. IgGs whose FcRn-binding ability has been reduced have shorter blood half-lives, and conversely, the blood half-life can be prolonged by increasing their binding ability toward FcRn. This way, previous methods for controlling the kinetics of IgG in blood involve modifying Fc to change the binding ability toward FcRn; however, the Working Examples of WO2007/114319 (mainly, techniques for substituting amino acids in the FR region) and WO2009/041643 (mainly techniques for substituting amino acids in the CDR region) showed that regardless of the target antigen type, by modifying the pI of the variable region of an antibody, its blood half-life can be controlled without modifying the Fc. The rate of non-specific uptake of an IgG antibody into endothelial cells is thought to depend on the physicochemical Coulombic interaction between the negatively charged cell surface and the IgG antibody. Therefore, it is considered that lowering (increasing) the pI of the IgG antibody and thus reducing (increasing) Coulombic interactions decreases (increases) its non-specific uptake into endothelial cells, and consequently decreases (increases) its metabolism in endothelial cells, thereby enabling the control of plasma pharmacokinetics. Since the Coulombic interaction between endothelial cells and the cell surface's negative charge is a physicochemical interaction, this interaction is considered not to depend primarily on the antibody-constituting amino acid sequence per se. Therefore, the methods for controlling plasma pharmacokinetics provided herein are not just applicable to specific antibodies, but they can be widely applied to any polypeptide containing an antibody variable region. Herein, a reduction (an increase) of Coulombic interactions means a decrease (an increase) of the Coulombic force represented as an attractive force and/or an increase (a decrease) of the Columbic force represented as a repulsive force.

The amino acid substitutions for accomplishing the above may be a single amino acid substitution or a combination of multiple amino acid substitutions. In some embodiments, a method is provided for introducing a single amino acid substitution or a combination of multiple amino acid substitutions into a position(s) exposed on the antibody molecule surface. Alternatively, the multiple amino acid substitutions introduced may be positioned conformationally close to each other. The inventors arrived at the idea that, for example, when substituting amino acids that may be exposed on the antibody molecule surface with positively charged amino acids (preferably arginine or lysine) or when using pre-existing positively charged amino acids (preferably arginine or lysine), it may be preferable to further substitute one or more amino acids that are conformationally proximal to those amino acids (in certain cases, even one or more amino acids buried within the antibody molecule) with positively charged amino acids to produce, as a result, a state of locally clustered positive charges at conformationally proximal positions. Here, the definition of "conformationally proximal position(s)" is not particularly limited, but for example, it may mean a state where a single amino acid substitution or multiple amino acid substitutions are introduced within 20A, preferably within 15A, or more preferably within 10A of one another. Whether the amino acid substitution of interest is at a position exposed on the antibody molecule surface, or whether the amino acid substitution is proximally positioned can be determined by known methods such as X-ray crystallography.

This way, by noting that the pI is one indicator representing the overall charge of the molecule, and that charges buried inside the antibody molecule and charges on the antibody molecule surface are treated without any distinction, the inventors also conceived that by producing an antibody molecule with broad and comprehensive consideration of the effects from charges, which include not only the pI but also the surface charges and local clustering of charges on antibody molecules, the speed of antigen elimination from the plasma can be further accelerated and the antigen concentration in the plasma can be maintained at even lower levels.

Receptors such as FcRn or FcγR are expressed on the cell membrane, and antibodies that have an enhanced affinity toward FcRn or FcγR under neutral pH conditions are thought to be taken up into cells mainly through these Fc receptors. Since the cell membrane is negatively charged, the administered antibody-antigen complex approaches the cell membrane more readily when its pI is high (the charge of the molecule as a whole is shifted toward positive charge), and uptake through the Fc receptor may take place more easily. Therefore, antibodies that have an enhanced affinity towards FcRn or FcγR under neutral pH conditions as well as an increased pI also show increased uptake into cells through Fc receptors when they form a complex with antigens. Accordingly, the speed of antigen elimination from the plasma by antibodies that bind to antigens in a pH-dependent manner and have an enhanced affinity toward FcRn or FcγR under neutral pH conditions can be hastened by increasing their pIs, and the plasma antigen concentration can be maintained at lower levels.

Example 3

Evaluation of the Extracellular Matrix Binding of pH-Dependent Binding Antibodies with Increased pIs (3-1) Evaluation of the Extracellular Matrix-Binding Ability The following experiment was carried out to evaluate the effects of conferring antibodies with the pH-dependent antigen-binding property and further modifying the pI on their extracellular matrix-binding ability.

In a manner similar to the method of Example 1, three types of antibodies with different pI were produced as antibodies that show pH-dependent binding toward the IL-6 receptor: Low_pI-IgG1, Middle_pI-IgG1, and High_pI-IgG1. As ordinary antibodies that do not show pH-dependent binding to the IL-6 receptor, Low_pI(NPH)-IgG1 comprising H54 (SEQ ID NO:34) and L28 (SEQ ID NO:35) and High_pI(NPH)-IgG1 comprising H(WT) (SEQ ID NO:36) and L(WT) (SEQ ID NO:37) described in WO2009125825 were produced by the method of Reference Example 2, respectively.

In a manner similar to the method of Example 1, the theoretical pI was calculated for these antibodies and shown in Table 4. Antibodies that do not show pH-dependent binding to the IL-6 receptor were also shown to have an increased pI similarly to antibodies that show pH-dependent binding.

TABLE 4

| Antibody Name | Theoretical pI |
| --- | --- |
| Low_pI-IgG1 | 6.39 |
| Middle_pI-IgG1 | 8.70 |
| High_pI-IgG1 | 9.30 |

TABLE 4-continued

| Antibody Name | Theoretical pI |
|---|---|
| Low_pI(NPH)-IgG1 | 6.10 |
| High_pI(NPH)-IgG1 | 9.35 |

(3-2) Evaluation of Antibody Binding to the Extracellular Matrix by the Electrochemiluminescence (ECL) Method The extracellular matrix (BD Matrigel Basement Membrane Matrix; manufactured by BD) was diluted to 2 mg/mL using TBS (Takara). The diluted extracellular matrix was dispensed into a MULTI-ARRAY 96 well Plate, High bind, Bare (manufactured by Meso Scale Discovery:MSD) at 5 µL per well, and immobilized overnight at 4° C. Then, 20 mM ACES buffer at pH 7.4 containing 150 mM NaCl, 0.05% Tween 20, 0.5% BSA, and 0.01% $NaN_3$ was dispensed into the plate for blocking. The antibodies to be evaluated were diluted to 30, 10, and 3 µg/mL using 20 mM ACES buffer at pH 7.4 (ACES-T buffer) containing 150 mM NaCl, 0.05% Tween 20, and 0.01% $NaN_3$, and then were further diluted using 20 mM ACES buffer at pH 7.4 containing 150 mM NaCl, 0.01% Tween 20, 0.1% BSA, and 0.01% $NaN_3$ (Dilution Buffer) to produce a final concentration of 10, 3.3, and 1 µg/mL, respectively. The diluted antibody solutions were added to the plate from which the blocking solution was removed, and this was shaken at room temperature for one hour. The antibody solutions were removed, ACES-T buffer containing 0.25% glutaraldehyde was added, and after letting this stand for 10 minutes, the plate was washed with DPBS (manufactured by Wako Pure Chemical Industries) containing 0.05% Tween 20. The antibodies for ECL detection were prepared by sulfo-tagging goat anti-human IgG (gamma) (manufactured by Zymed Laboratories) using Sulfo-Tag NHS Ester (manufactured by MSD). Antibodies for detection were diluted in a dilution buffer to be 1 µg/mL, added to the plate, and then shaken in the dark at room temperature for one hour. The antibodies for detection were removed, and a 2-fold diluted solution prepared by diluting MSD Read Buffer T (4×) (manufactured by MSD) with ultrapure water was added; and then the amount of luminescence was measured on SECTOR Imager 2400 (manufactured by MSD).

Figure 5:
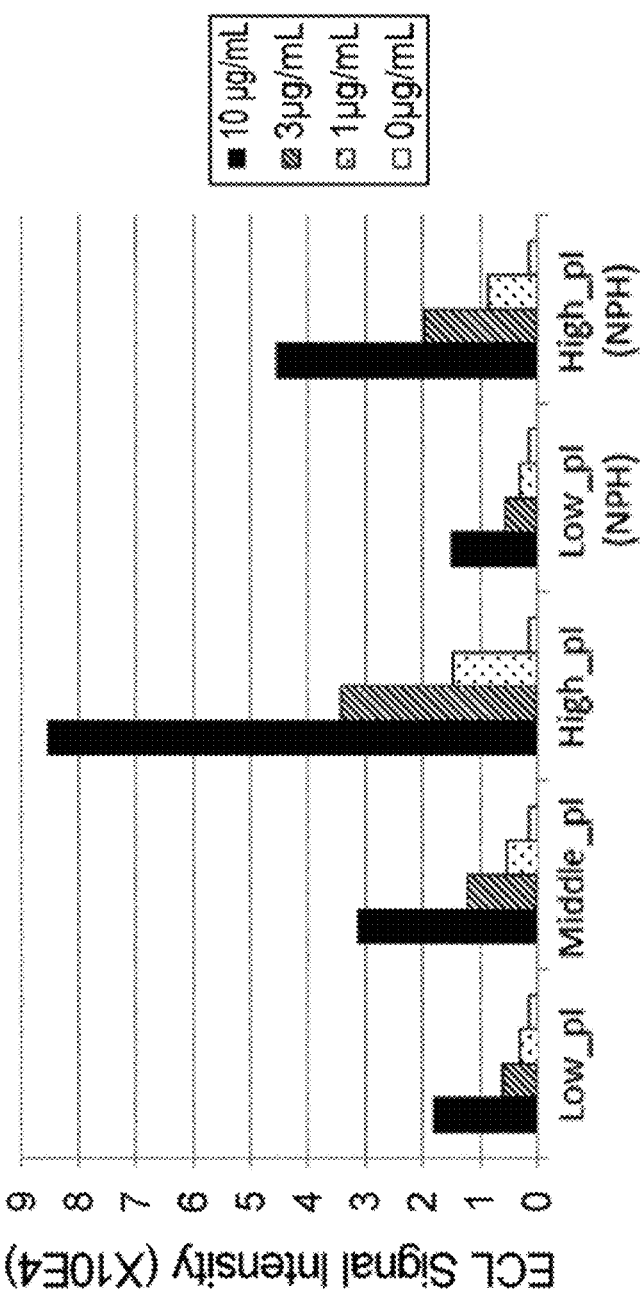

The results are shown in FIG. 5. Antibodies showing pH-dependent binding as well as antibodies that do not show pH-dependent binding both showed increased binding toward the extracellular matrix by increasing their pIs. Furthermore, surprisingly, the effect of improving extracellular matrix binding by increasing the pI was significant in the antibodies with pH-dependent antigen binding. In other words, the antibody that binds to an antigen in a pH-dependent manner and has high pI (High_pI-IgG1) was found to have the strongest affinity toward the extracellular matrix.

Without being limited to a particular theory, results obtained from these experiments can also be explained as follows. The introduction of histidine modifications into the antibody variable region is known to be one method for conferring pH-dependent antigen-binding property to an antibody (see e.g., WO2009/125825). Histidine has an imidazoyl group on its side chain, and is uncharged under neutral pH to basic pH conditions, but it is known to be positively charged under acidic pH conditions. Using this property of histidine, by introducing histidine into the antibody variable region, particularly in the CDR(s) positioned close to the site of interaction with the antigen, one can change the charge environment and conformational environment at the site of interaction with the antigen between the neutral and acidic pH conditions. Such antibodies can be expected to have an antigen affinity that changes in a pH-dependent manner. Those of ordinary skill in the art will understand that the effects obtained by such introduction(s) of histidine do not primarily (or substantially) depend on the type of target antigen or the amino acid sequence that constitutes the antibody, but depend on the site of histidine introduction or the number of histidine residues introduced.

WO2009/041643 describes in general terms as follows: protein-protein interactions consist of hydrophobic interactions, electrostatic interactions, and hydrogen bonds, and the strength of such binding can usually be represented using a binding constant (affinity) or an apparent binding constant (avidity). pH-dependent binding, where the strength of binding changes between a neutral pH condition (e.g., pH 7.4) and an acidic pH condition (for example, pH 5.5 to pH 6.0), depends on naturally-occurring protein-protein interactions. For example, the aforementioned binding between an IgG molecule and FcRn, which is known to be a salvage receptor for the IgG molecule, shows strong binding under acidic pH conditions and very weak binding under neutral pH conditions. Histidine residues are involved in many of the protein-protein interactions that change in a pH-dependent manner. Since the pKa of a histidine residue is close to 6.0 to 6.5, the state of proton dissociation in the histidine residue changes between neutral and acidic pH conditions. More specifically, the histidine residue is uncharged and neutral under neutral pH conditions, and functions as a hydrogen atom acceptor; while under acidic pH conditions, it is positively charged and functions as a hydrogen atom donor. Also in the IgG molecule-FcRn interaction described above, histidine residues present on the IgG molecule have been reported to be involved in pH-dependent binding (Martin et al., *Mol. Cell.* 7(4):867-877 (2001)).

Therefore, substituting a histidine residue for an amino acid residue involved in the protein-protein interaction, or introducing a histidine at an interacting site can confer pH dependence to protein-protein interactions. A similar undertaking has been made for protein-protein interactions between an antibody and an antigen; and an antibody mutant with decreased antigen affinity under acidic pH conditions has been successfully obtained by introducing histidine into the CDR sequence of an anti-egg-white lysozyme antibody (Ito et al., *FEBS Lett.* 309(1):85-88 (1992)). Furthermore, antibodies have been reported which specifically bind to antigens under the low pH of cancer tissues and weakly bind the corresponding antigen under neutral pH conditions due to introduction of histidine in the CDR sequence (WO2003/105757).

Meanwhile, an amino acid residue that is introduced to increase the pI is preferably lysine, arginine, or histidine which have positively charged side chains. The standard pKa for these amino acid side chains is 10.5 for lysine, 12.5 for arginine, and 6.0 for histidine (Skoog et al., *Trends Anal. Chem.* 5(4):82-83 (1986)). Based on the acid-base equilibrium theory known in the art, these pKa values mean that in a solution of pH 10.5, 50% of the lysine side chains are positively charged and the remaining 50% are uncharged. As the pH of the solution increases, the positively charged proportion of lysine side chains decreases, and in a solution of pH 11.5 which is 1 pH value higher than the pKa for lysine, the positively charged proportion becomes approximately 9%. On the other hand, as the pH of the solution decreases, the positively charged proportion increases, and in a solution of pH 9.5 which is 1 pH value lower than the pKa of lysine, the positively charged proportion becomes approximately 91%. This theory works in a similar manner for arginine and histidine as well. More specifically, nearly 100% of lysine or arginine is positively charged in a solution at neutral pH (for example, pH 7.0), whereas approximately 9% of histidine is positively charged. Therefore, while histidine is positively charged under neutral pH conditions, since that level is low compared to lysine or arginine, lysine and arginine are considered as more favorable amino acids to be introduced for increasing the pI. Furthermore, according to Holash et al. (*Proc. Natl. Acad. Sci.* 99(17):11393-11398 (2002), while the introduction of modifications that increase the pI have been considered to be effective as modifications for increasing extracellular matrix binding, substitutions introducing lysine or arginine have been considered to be more favorable amino acid modifications than substitutions introducing histidine for the above-mentioned reasons.

As first disclosed herein, a surprising synergistic increase in the affinity of an antibody toward extracellular matrix is possible by combining the introduction of histidine to confer the pH-dependent antigen-binding property along with a pI-increasing modification of the antibody. In fact, while the pI of High_pI-IgG1 was 9.30, the pI of High_pI(NPH)-IgG1 was 9.35, and therefore the value for High_pI-IgG1 was slightly lower. Nevertheless, the actual affinity towards extracellular matrix was clearly stronger for High_pI-IgG1. This shows that the affinity towards extracellular matrix cannot be necessarily explained by just the pI level, and can be said to show a synergistic effect from introducing a combination of pI-increasing modifications and histidine modifications. This result is a phenomenon that was both surprising and unexpected.

However, one must note that since the pKa of the amino acid side chains in a protein are greatly affected by the surrounding environment, they will not always match the above-mentioned theoretical pKa values. More specifically, the above description is presented herein based on general scientific theory; however, one can easily speculate that there may be many exceptions in actual proteins. For example, in Hayes et al., *J. Biol. Chem.* 250(18):7461-7472 (1975), when the pKa of histidine contained in myoglobin was determined experimentally, while the values centered around 6.0, they were reported to vary from 5.37 to 8.05. Naturally, histidine which has a high pKa will be mostly positively charged under neutral pH conditions. Therefore, the above-mentioned theory does not negate the pI-increasing effect of introducing histidine and in the actual three-dimensional structure of the protein. It is sufficiently possible that an amino acid modification introducing histidine, as seen in the case with lysine or arginine, may also to exert an effect of pI increase.

Example 4 pI Increase by One Amino Acid Substitution in the Constant Region

Methods for increasing the pI of an antibody that binds to an antigen in a pH-dependent manner by introducing amino acid substitutions into the antibody variable region have been described. In addition, methods for increasing the pI of an antibody can also be carried out by performing as few as one amino acid substitution in the antibody constant region.

The method of adding one amino acid substitution to the antibody constant region to increase pI is not particularly limited, but for example, it can be performed by the method described in WO2014/145159. As in the case with the variable region, amino acid substitutions introduced into the constant region are preferably those that decrease the number of negatively charged amino acids (such as, aspartic acid or glutamic acid) while increasing the positively charged amino acids (such, as arginine or lysine).

Without limitation, the positions for introducing amino acid substitutions in the constant regions are preferably positions where amino acid side chains may be exposed on the antibody molecule surface. Preferable examples include the method of introducing a combination of multiple amino acid substitutions at such positions that may be exposed on the antibody molecule surface. Alternatively, the multiple amino acid substitutions introduced are preferably positioned so that they are conformationally close to each other. Furthermore, without limitation, the multiple amino acid substitutions introduced are preferably substitutions to positively charged amino acids, so that in certain cases they result in a state where multiple positive charges are present at conformationally proximal positions. The definition of a "conformationally proximal position" is not particularly limited, but for example, it may mean a state where a single amino acid substitution or multiple amino acid substitutions are introduced within 20A, preferably within 15A, or more preferably within 10A of one another. Whether the amino acid substitution of interest is at a position exposed on the antibody molecule surface, or whether the multiple positions of amino acid substitutions are proximally positioned can be determined by known methods such as X-ray crystallography.

Furthermore, the method for conferring multiple positive charges at conformationally proximal positions include, in addition to the above-mentioned methods, a method of using amino acids that are originally positively charged in an IgG constant region. Examples of such positively charged amino acid positions include (a) arginine at position 255, 292, 301, 344, 355, or 416, according to EU numbering; and (b) lysine at position 121, 133, 147, 205, 210, 213, 214, 218, 222, 246, 248, 274, 288, 290, 317, 320, 322, 326, 334, 338, 340, 360, 370, 392, 409, 414, or 439, according to EU numbering. By performing substitution with a positively charged amino acid at a position conformationally proximal to these positively charged amino acids, it is possible to confer multiple positive charges at conformationally proximal positions.

(4-1) Production of pH-Dependent Anti-IgE Binding Antibodies

The following three antibodies were produced by the method of Reference Example 2 as pH-dependent anti-human IgE antibodies: (1) Ab1, which is a conventional antibody comprising Ab1H (SEQ ID NO:38) as the heavy chain and Ab1L (SEQ ID NO:39) as the light chain; (2) Ab2, which is a conventional antibody comprising Ab2H (SEQ ID NO:40) as the heavy chain and Ab2L (SEQ ID NO:41) as the light chain; and (3) Ab3, which is a conventional antibody comprising Ab3H (SEQ ID NO:42) as the heavy chain and Ab3L (SEQ ID NO:43) as the light chain.

(4-2) Evaluation of pH Dependence in Human IgE Binding

Affinities of Ab1 toward human IgE at pH 7.4 and pH 5.8 were evaluated as follows. Kinetic analyses of human IgE and Ab1 were performed using BIACORE T100 (GE Healthcare). Measurements were carried out using the following two buffers as the running buffers: (1) 1.2 mM $CaCl_2$/0.05% tween 20, 20 mM ACES, 150 mM NaCl, pH 7.4; and (2) 1.2 mM $CaCl_2$/0.05% tween 20, 20 mM ACES, 150 mM NaCl, pH 5.8.

An appropriate amount of Protein A/G (ACTIGEN) was fixed onto Sensor chip CM4 (GE Healthcare) by the amine coupling method to capture the antibodies of interest. Next, human IgE was made to interact with the antibodies captured onto the sensor chip by injecting a diluted IgE solution and a running buffer (used as a reference solution). For the running buffer, either of the buffers (1) and (2) above was used, and human IgE was diluted using the respective buffer. To regenerate the sensor chip, 10 mM glycine-HCl at pH 1.5 was used. All measurements were carried out at 25° C. KD (M) for human IgE was calculated for each antibody based on the association rate constant ka (1/Ms) and dissociation rate constant kd (1/s), which are kinetic parameters calculated from the sensorgrams obtained by the measurements. The BIACORE T100 Evaluation Software (GE Healthcare) was used to calculate each parameter.

Affinities of Ab2 and Ab3 for human IgE at pH 7.4 and pH 5.8 were evaluated as follows. The binding activity (dissociation constant KD (M)) of anti-hIgE antibodies toward hIgE were evaluated using BIACORE T200 (GE Healthcare). Measurements were carried out using the following two buffers as the running buffers: (1) 1.2 mM $CaCl_2$/0.05% tween 20, 20 mM ACES, 150 mM NaCl, pH 7.4; and (2) 1.2 mM $CaCl_2$/0.05% tween 20, 20 mM ACES, 150 mM NaCl, pH 5.8.

An appropriate amount of a peptide produced by adding biotin to Lys present at the C terminus of a chemically synthesized human glypican 3 (a.k.a., GPC3) protein-derived peptide (having the amino acid sequence of (VDDAPGNSQQATPKDNEISTFHNLGNVHSPLK (SEQ ID NO:44))("biotinylated GPC3 peptide") was added to Sensor chip SA (GE Healthcare) and immobilized onto the chip by utilizing the affinity between streptavidin and biotin. An appropriate concentration of hIgE was injected and immobilized onto the chip by capturing of the biotinylated GPC3 peptide. An appropriate concentration of an anti-hIgE antibody was injected as an analyte, and this was made to interact with hIgE on the sensor chip. Then, to regenerate the sensor chip, 10 mM glycine-HCl at pH 1.5 was injected. All measurements were carried out at 37° C. Association rate constants ka (1/Ms) and dissociation rate constants kd (1/s) were calculated by analyzing the measurement results by curve-fitting using the BIACORE T200 Evaluation Software (GE Healthcare), and dissociation constants KD (M) were calculated based on those values.

The results are presented in Table 5. All antibodies, Ab1, Ab2, and Ab3, showed pH-dependent binding toward human IgE, and their affinity at an acidic pH condition (pH 5.8) was shown to be dramatically weakened when compared with their affinity at a neutral pH condition (pH 7.4). Accordingly, administration of these antibodies to a living animal is expected to show an effect of accelerating the elimination of human IgE which is the antigen.

TABLE 5

| Antibody Name | Buffer pH Condition | ka (1/Ms) | Kd (1/s) | KD (M) |
|---|---|---|---|---|
| Ab1 | pH7.4 | 2.7E+06 | 6.0E−03 | 2.3E−09 |
|  | pH5.8 | 1.6E+04 | 3.9E−02 | 2.4E−06 |
| Ab2 | pH7.4 | 2.9E+06 | 4.5E−03 | 1.5E−09 |
|  | pH5.8 | 5.5E+05 | 5.3E−02 | 9.7E−08 |
| Ab3 | pH7.4 | 1.6E+06 | 7.9E−03 | 4.9E−09 |
|  | pH5.8 | 1.4E+05 | 3.3E−02 | 2.3E−07 |

The theoretical pI values (pIs) for Ab1-Ab3 calculated in a similar manner to the method of Example 1 are shown in Table 6.

TABLE 6

| Antibody Name | Theoretical pI |
|---|---|
| Ab1 | 6.77 |
| Ab2 | 6.48 |
| Ab3 | 6.48 |

(4-3) Production of Antibodies with Increased-pI by a Single Amino Acid Modification in the Constant Region Ab1 produced in Example (4-1) is an antibody having native human IgG1 as the constant region. Ab1H-P600 was produced by modifying the Fc region of Ab1H, which is the heavy chain of Ab1, through substituting the proline at position 238 according to EU numbering with aspartic acid and substituting the serine at position 298 according to EU numbering with alanine. Furthermore, various Fc variants were produced by the method of Reference Example 2 by introducing the various single amino acid substitutions indicated in Tables 7-1 and 7-2 into the Fc region of Ab1H-P600, respectively. For all of the Fc variants, Ab1L (SEQ ID NO:39) was used as the light chain. The affinity of these antibodies for hFcγRII2b was comparable to the P600 variant (data not shown).

TABLE 7-1

| Variant Name | Amino Acid Mutation Added to P600 | Biacore | Imaging |
|---|---|---|---|
| P600 | None | 1.00 | 1.00 |
| P828 | Q196K | 1.27 | 0.98 |
| P829 | S337R | 0.17 | 0.89 |
| P830 | L358K | 1.24 | 2.35 |
| P831 | P387R | 3.85 | 1.30 |
| P836 | E345Q | 1.85 | No Data |
| P837 | E345R | 1.88 | No Data |
| P838 | D356Q | 1.87 | No Data |
| P839 | D356N | 2.17 | No Data |
| P840 | T359K | 2.25 | No Data |
| P841 | N361R | 1.86 | No Data |
| P842 | Q362K | 2.37 | No Data |
| P843 | E380R | −0.04 | No Data |
| P844 | E382Q | 1.24 | No Data |
| P845 | E382K | 1.38 | No Data |
| P846 | Q386K | 1.71 | No Data |
| P847 | N389K | 1.57 | No Data |
| P848 | S415R | 1.38 | No Data |
| P849 | Q418R | 2.21 | No Data |
| P850 | Q419K | 2.22 | No Data |
| P851 | N421R | 1.43 | 1.56 |
| P852 | S424K | 1.40 | No Data |
| P854 | L443R | 1.93 | No Data |
| P905 | N384R | 1.34 | 2.36 |
| P906 | G385R | 1.74 | 1.12 |
| P907 | H433R | 0.09 | 3.55 |
| P908 | N434R | 0.42 | 1.88 |
| P909 | H435R | 0.73 | 0.77 |
| P910 | L309R | 1.73 | 1.80 |
| P912 | T307R | 0.24 | 1.30 |
| P914 | D399R | 1.72 | 3.78 |
| P915 | S400R | 0.85 | 2.01 |
| P917 | A327R | −0.05 | 2.49 |
| P918 | L328R | −0.06 | 0.00 |
| P919 | P329R | −0.06 | 0.00 |

TABLE 7-2

| P920 | A330R | 0.01 | 1.67 |
| P921 | P331R | −0.07 | 0.02 |
| P923 | Q311R | 1.63 | 2.88 |
| P924 | N315R | 2.08 | 2.66 |
| P925 | Y296R | −0.05 | 0.34 |

TABLE 7-2-continued

| | | | |
|---|---|---|---|
| P926 | Q295R | −0.06 | 0.04 |
| P927 | E294R | 0.25 | 0.29 |
| P928 | E293R | 0.20 | 0.04 |
| P929 | P291R | 0.47 | 0.53 |
| P930 | A287R | −0.07 | 0.00 |
| P931 | N286R | 0.68 | 1.27 |
| P932 | H285R | 1.38 | 1.96 |
| P934 | V282R | 1.54 | 1.67 |
| P935 | G281R | −0.06 | 2.14 |
| P937 | E272R | 0.21 | 0.56 |
| P938 | P271R | −0.06 | 0.04 |
| P939 | D270R | −0.07 | 0.01 |
| P940 | E269R | −0.05 | 0.01 |
| P941 | H268R | 0.47 | 0.44 |
| P942 | E258R | No Data | 3.07 |
| P944 | T256R | No Data | 1.49 |
| P945 | S254R | No Data | 5.70 |
| P946 | I253R | No Data | 1.05 |
| P947 | M252R | No Data | 0.94 |
| P948 | L251R | No Data | 0.13 |

Figure 6:
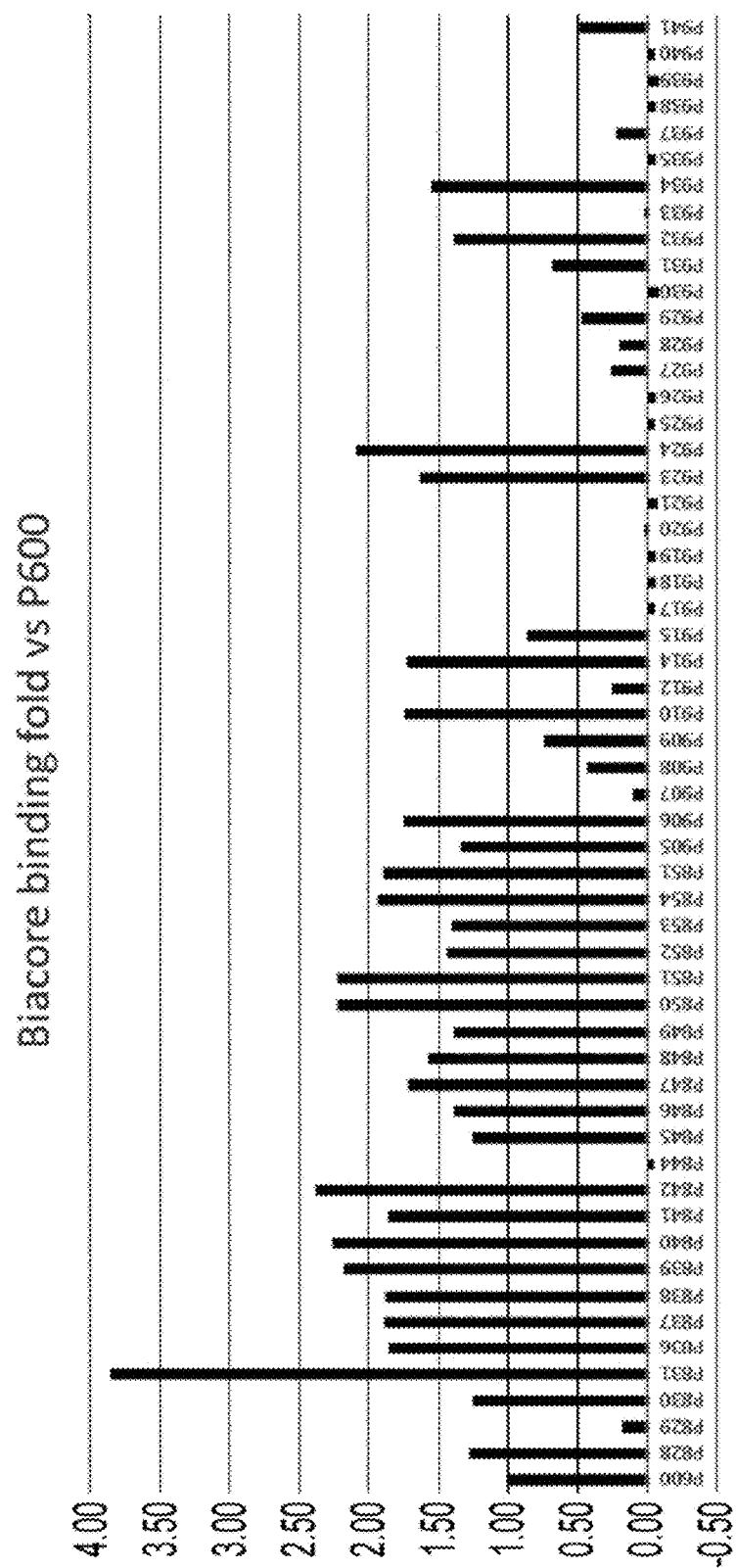
FIG. 6 shows relative values of the extent of soluble human FcγRIIb binding (measured by BIACORE®) of antibodies that comprise an Fc region variant each of whose pI has been increased by modifying one amino acid residue in the constant region of the Ab1H-P600 antibody which binds to IgE in a pH-dependent manner, by setting the value of Ab1H-P600 to 1.00.

(4-4) Human FcγRIIb-Binding Assay by BIACORE Using Novel Fc Region Variant-Containing Antibodies Fc region variant-containing antibody binding assays between soluble human FcγRIIb (a.k.a. "hFcγRIIb") and antigen-antibody complexes were performed using BIACORE® T200 (GE Healthcare). Soluble hFcγRIIb was produced in the form of a His-tagged molecule using methods known in the art. An appropriate amount of an anti-His antibody was fixed onto Sensor chip CM5 (GE Healthcare) by the amine coupling method using a His capture kit (GE Healthcare) to capture hFcγRIIh. Next, an antibody-antigen complex and a running buffer (as a reference solution) was injected, and interaction was allowed to take place with the hFcγRIIb captured onto the sensor chip. 20 mM N-(2-Acetamido)-2-aminoethanesulfonic acid, 150 mM NaCl, 1.2 mM $CaCl_2$, and 0.05% (w/v) Tween 20 at pH 7.4 was used as the running buffer, and the respective buffer was also used to dilute the soluble hFcγRIIb. To regenerate the sensor chip, 10 mM glycine-HCl at pH 1.5 was used. All measurements were carried out at 25° C. Analyses were performed based on binding (RU) calculated from sensorgrams obtained by the measurements, and relative values when the binding amount of P600 was defined as 1.00 are shown. To calculate the parameters, the BIACORE® T100 Evaluation Software (GE Healthcare) was used. The results are shown in Tables 7-1 and 7-2 (see the "BIACORE" column in the Tables) and in FIG. 6. Several Fc variants were shown to have enhanced affinity toward hFcγRIIb fixed on the BIACORE® sensor chip.

While not being restricted to a particular theory, this result can be explained as follows. The BIACORE® sensor chip is known to be negatively charged, and this charged state can be considered to resemble the cell membrane surface. More specifically, the binding of an antigen-antibody complex for hFcγRIIb fixed onto the negatively charged BIACORE sensor chip is surmised to resemble the manner in which the antigen-antibody complex binds to hFcγRIIb present on a negatively charged cell membrane surface.

The antibodies produced by introducing the pI-increasing modification into the Fc region are antibodies in which the charge of the Fc region (constant region) is more positively charged when compared with those before introduction of the modification. Therefore, the Coulombic interaction between the Fc region (positive charge) and the sensor chip surface (negative charge) can be considered to have been strengthened by the pI-increasing amino acid modification. Furthermore, such effects are expected to take place similarly on the negatively charged cell membrane surface; therefore, they are also expected to show an effect of accelerating the speed or rate of uptake into cells in vivo.

From the above results, a ratio of above about 1.2 fold or more for the binding to hFcγRIIb of a variant when compared to the binding to hFcγRIIb of Ab1H-P600 was considered to have strong charge effect on binding of an antibody to hFcγRIIb on the sensor chip. Thus, a modification that is expected to yield a charge effect includes, for example, a modification at position 196, 282, 285, 309, 311, 315, 345, 356, 358, 359, 361, 362, 382, 384, 385, 386, 387, 389, 399, 415, 418, 419, 421, 424, or 443, according to EU numbering. Preferably the modification is at position 282, 309, 311, 315, 345, 356, 359, 361, 362, 385, 386, 387, 389, 399, 418, 419, or 443. The amino acid substitution introduced at such position is preferably arginine or lysine. Another example of an amino acid mutation position where such a charge effect can be expected includes the glutamic acid at position 430 according to EU numbering. The preferred amino acid substitution to be introduced at position 430 is arginine or lysine which is positively charged, or among uncharged residues, substitution to glycine or threonine is preferred.

(4-5) Uptake of Fc Region Variant-Containing Antibodies by hFcγRIIb-Expressing Cells To evaluate the rate of intracellular uptake into an hFcγRIIb-expressing cell line using the produced novel Fc region variant-containing antibodies, the following assay was performed.

An MDCK (Madin-Darby canine kidney) cell line that constitutively expresses hFcγRIIb was produced using known methods. Using these cells, intracellular uptake of antigen-antibody complexes was evaluated. Specifically, pHrodoRed (Life Technologies) was used to label human IgE (antigen) according to an established protocol, and antigen-antibody complexes were formed in a culture solution with the antibody concentration being 10.8 mg/mL and the antigen concentration being 12.5 mg/mL. The culture solution containing the antigen-antibody complexes was added to culture plates of the above-mentioned MDCK cells which constitutively express hFcγRIIb and incubated for one hour, and then the fluorescence intensity of the antigen taken up into the cells was quantified using InCell Analyzer 6000 (GE healthcare). The amount of antigen taken up was presented as relative values to the P600 value which is taken as 1.00.

Figure 7:
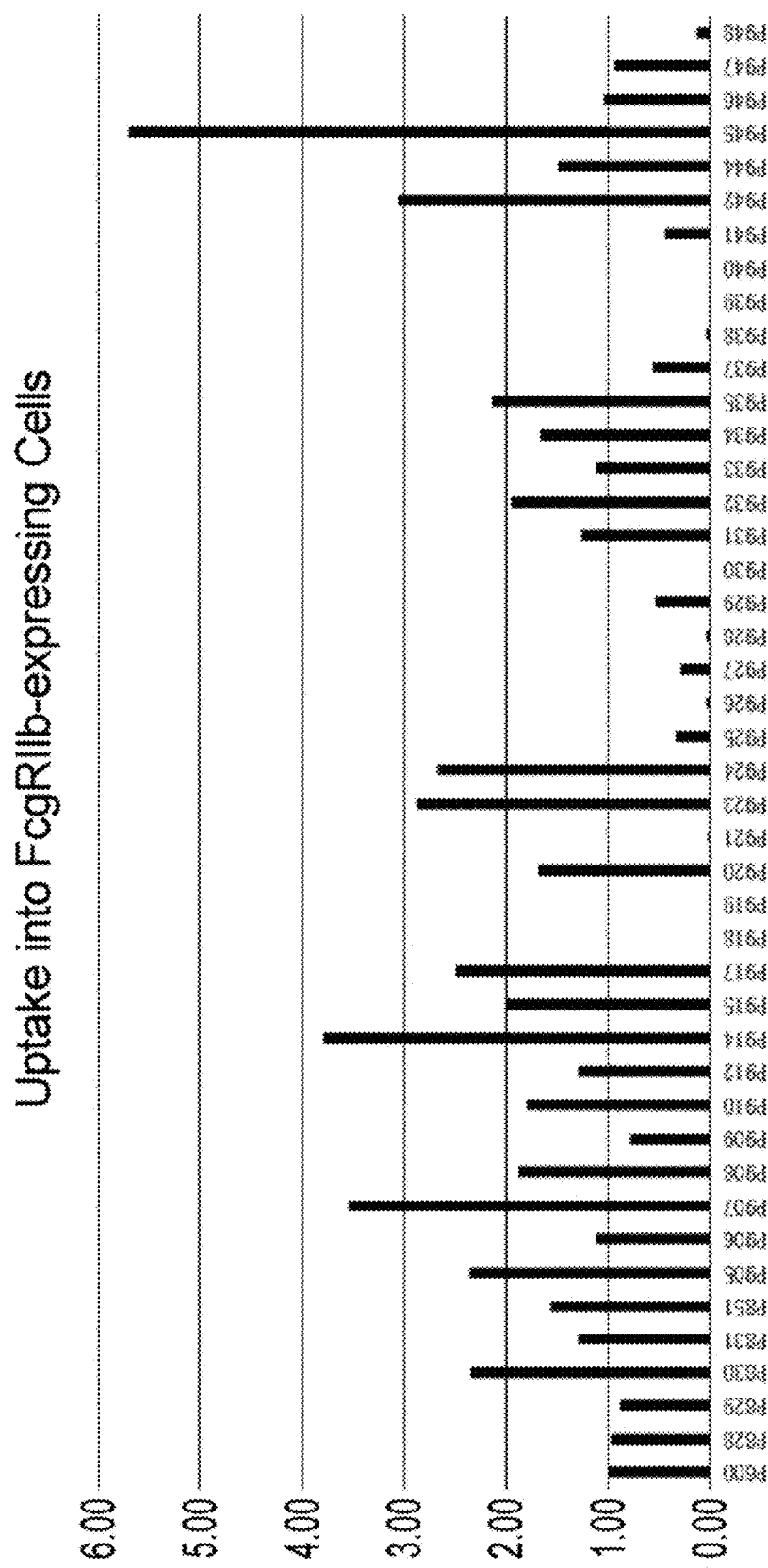
FIG. 7 shows relative values of the rate at which antibodies that comprise an Fc region variant each of whose pI has been increased by modifying one amino acid residue in the constant region of Ab1H-P600 are taken up into cells of an hFcγRIIb-expressing cell line, respectively, evaluated with the value of Ab1H-P600 set to 1.00.
Figure 8:
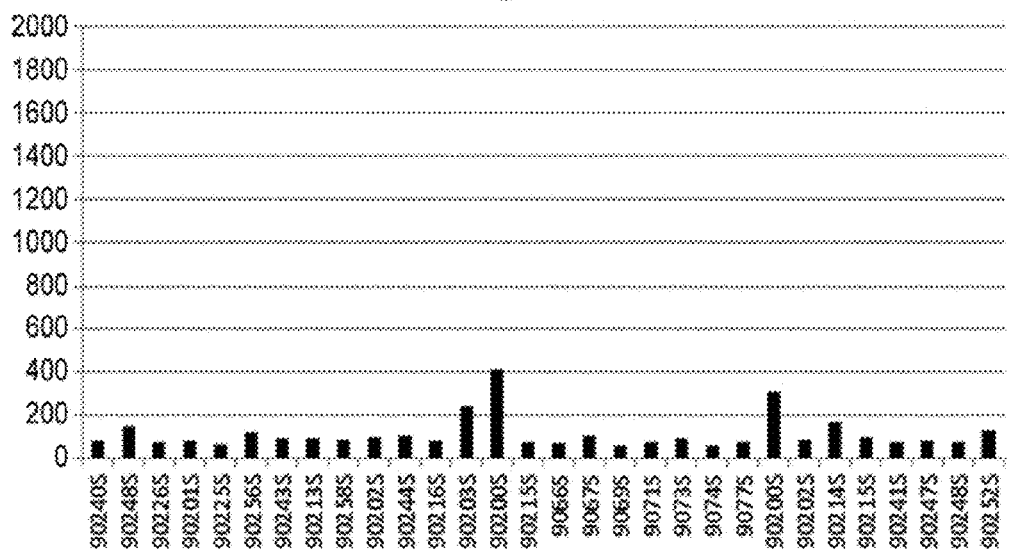
FIG. 8 shows the extent of binding of Fv4-IgG1, which has the Fc region of a native human IgG1, to rheumatoid factor in the serum of each RA patient.
Figure 9:
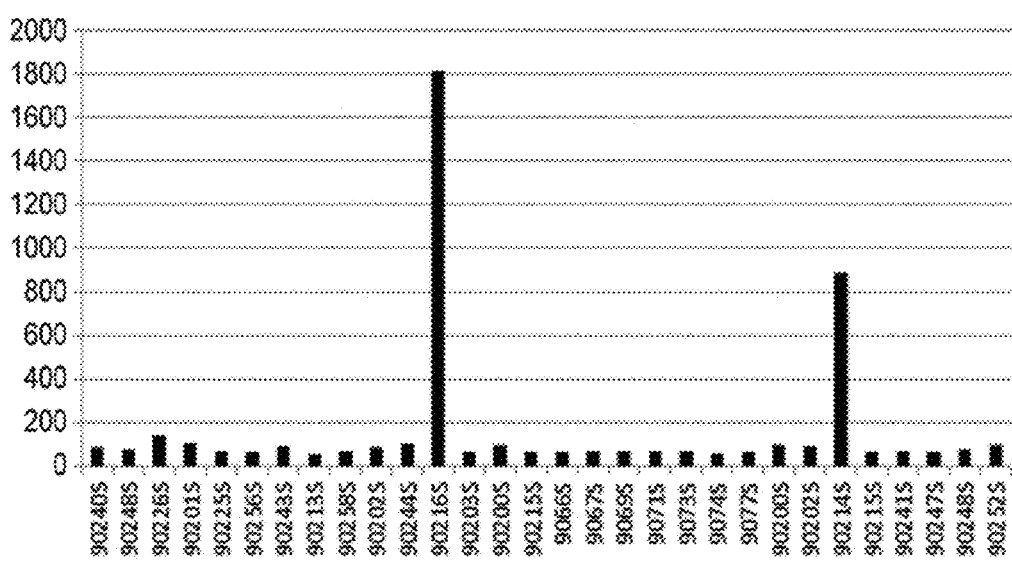
FIG. 9 shows the extent of binding of Fv4-YTE, which has an Fc region variant with increased FcRn binding, to rheumatoid factor in the serum of each RA patient.
Figure 10:
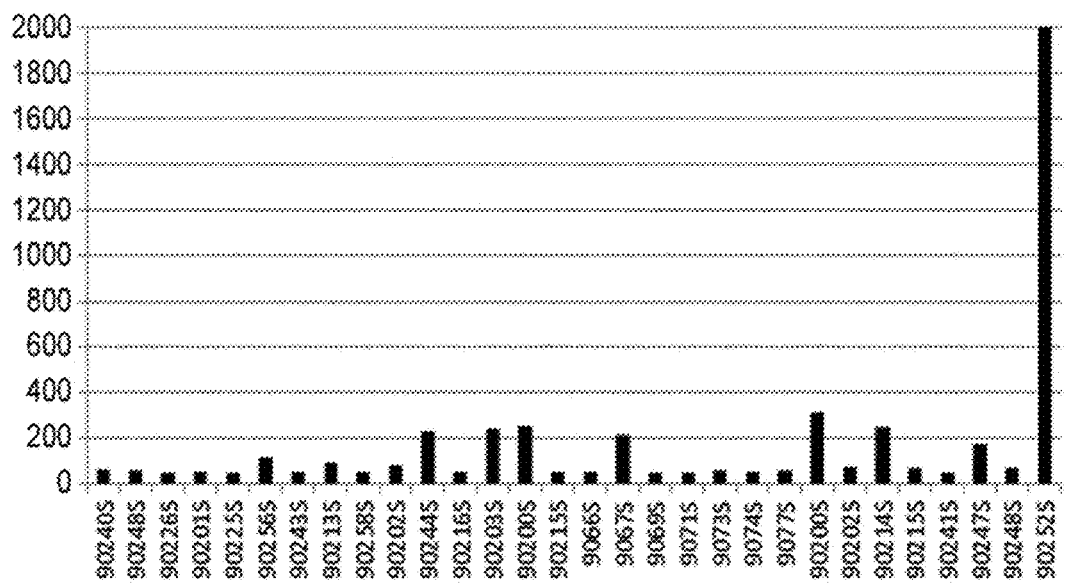
FIG. 10 shows the extent of binding of Fv4-LS, which has an Fc region variant with increased FcRn binding, to rheumatoid factor in the serum of each RA patient.
Figure 11:
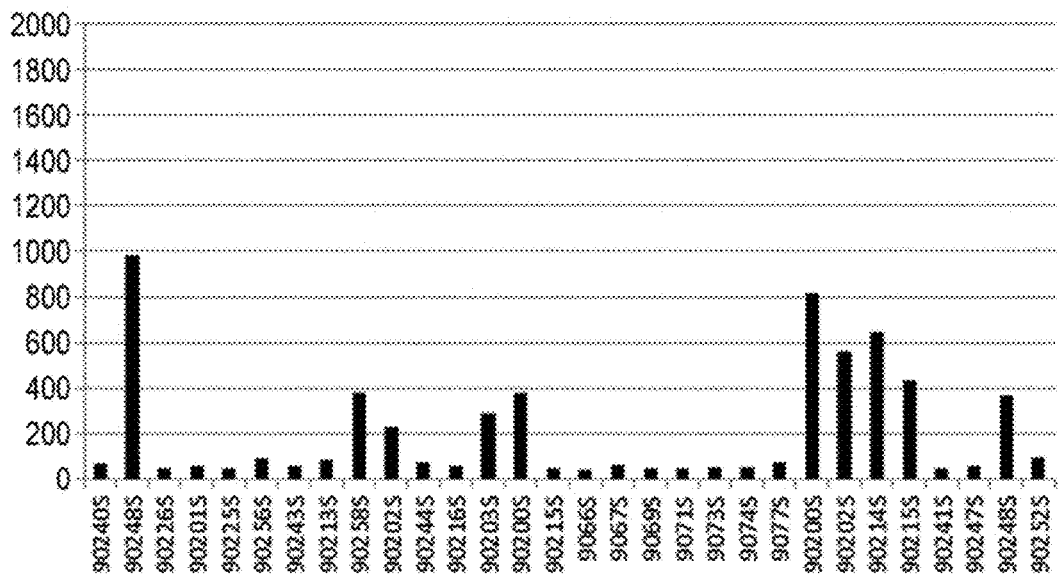
FIG. 11 shows the extent of binding of Fv4-N434H, which has an Fc region variant with increased FcRn binding, to rheumatoid factor in the serum of each RA patient.
Figure 12:
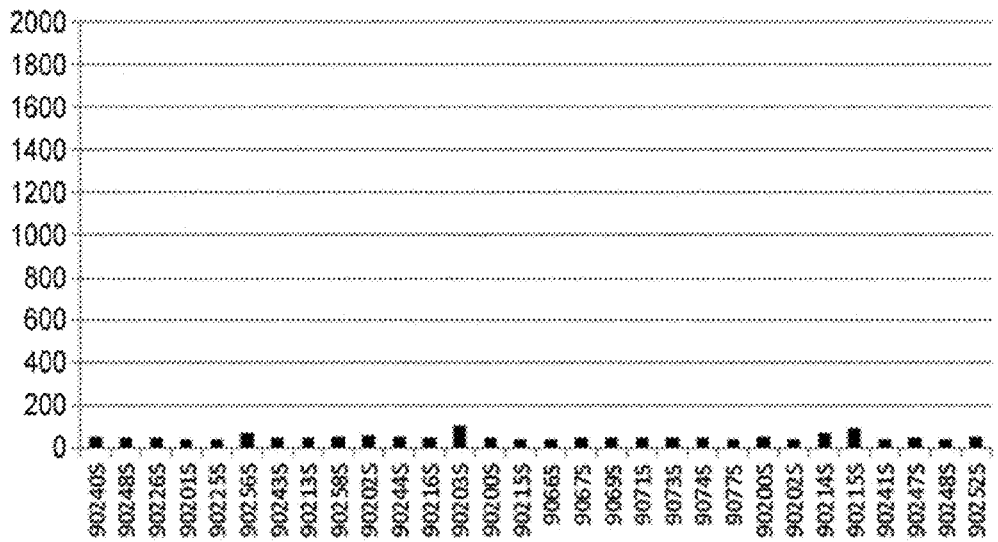
FIG. 12 shows the extent of binding of Fv4-F1847m, which has an Fc region variant with increased FcRn binding, to rheumatoid factor in the serum of each RA patient.
Figure 13:
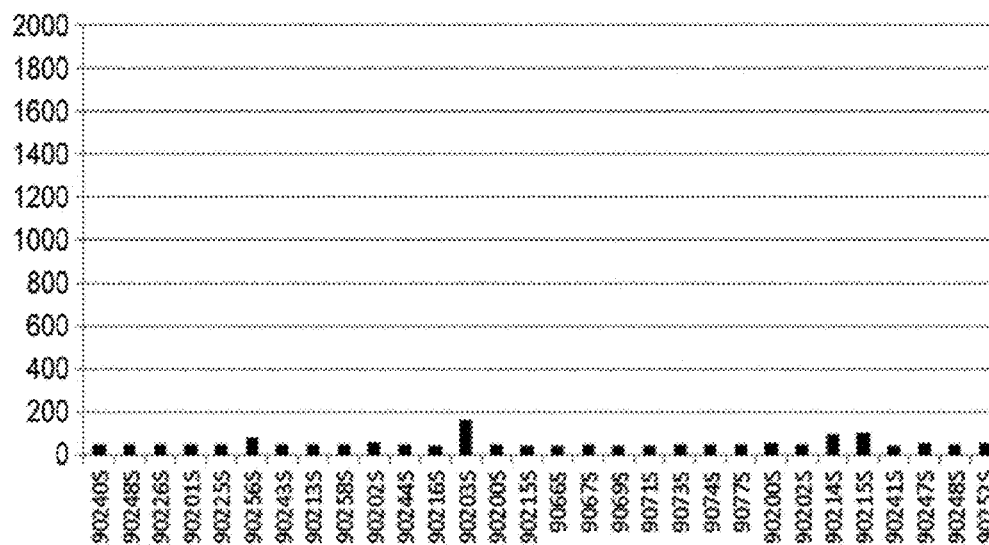
FIG. 13 shows the extent of binding of Fv4-F1848m, which has an Fc region variant with increased FcRn binding, to rheumatoid factor in the serum of each RA patient.
Figure 14:
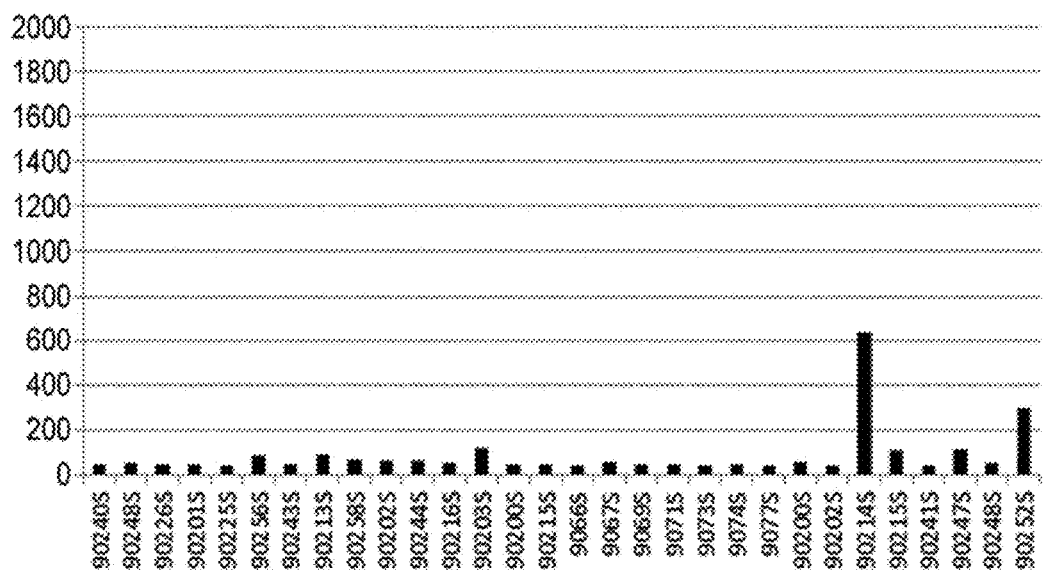
FIG. 14 shows the extent of binding of Fv4-F1886m, which has an Fc region variant with increased FcRn binding, to rheumatoid factor in the serum of each RA patient.
Figure 15:
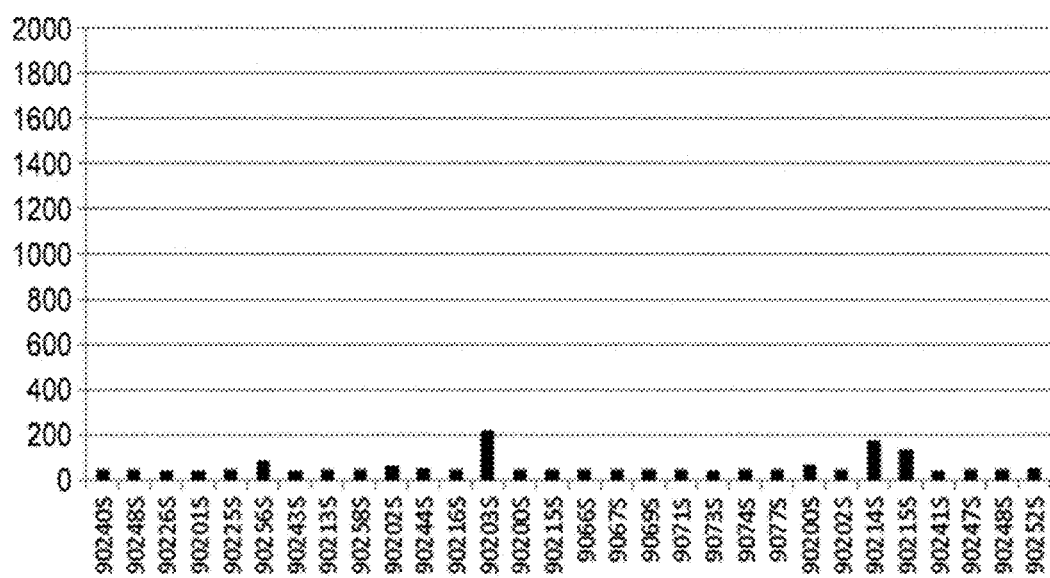
FIG. 15 shows the extent of binding of Fv4-F1889m, which has an Fc region variant with increased FcRn binding, to rheumatoid factor in the serum of each RA patient.
Figure 16:
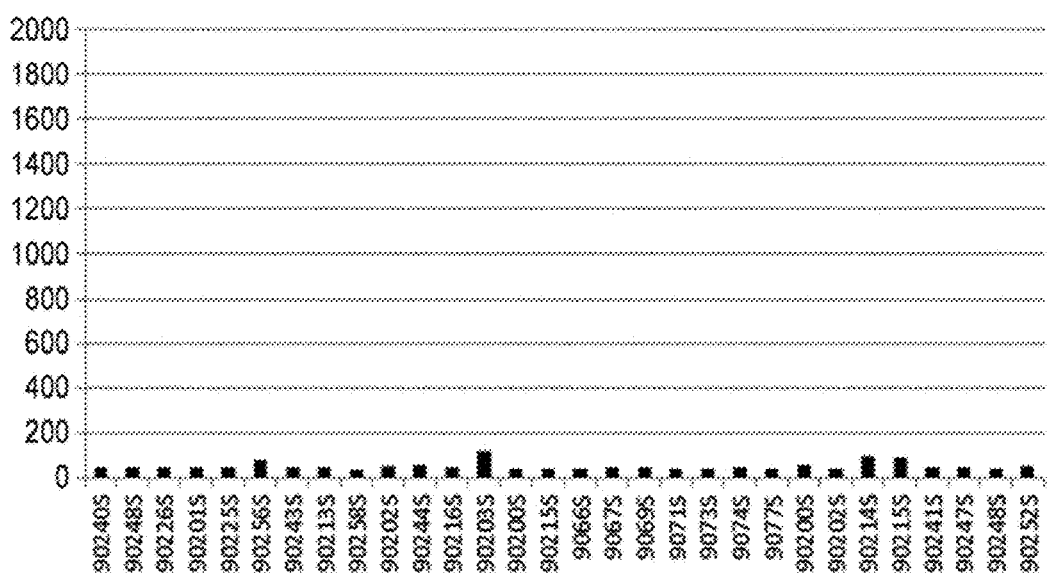
FIG. 16 shows the extent of binding of Fv4-F1927m, which has an Fc region variant with increased FcRn binding, to rheumatoid factor in the serum of each RA patient.
Figure 17:
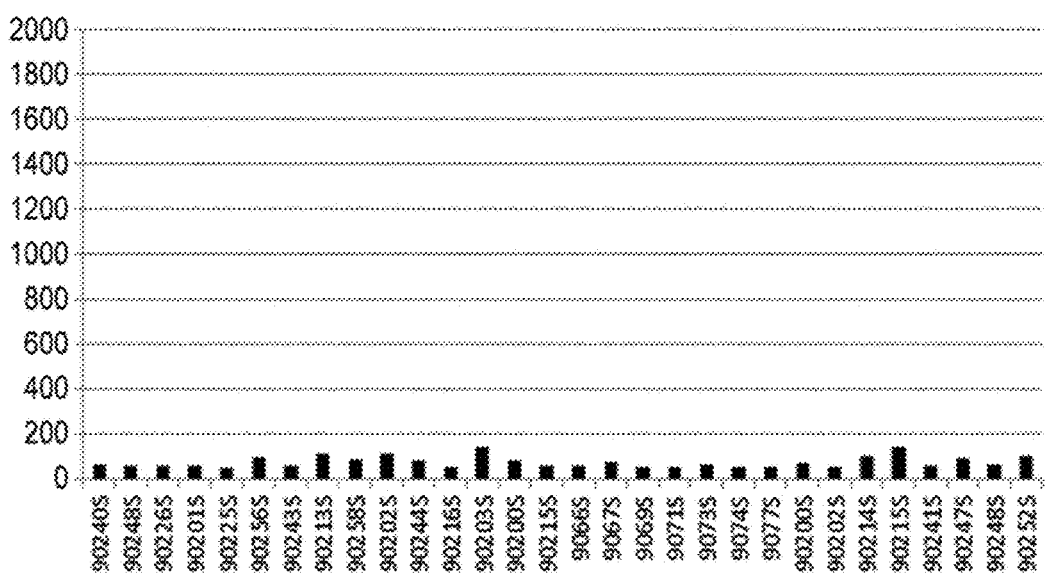
FIG. 17 shows the extent of binding of Fv4-F1168m, which has an Fc region variant with increased FcRn binding, to rheumatoid factor in the serum of each RA patient.

The results are shown in Tables 7-1 and 7-2 (see the "Imaging" column in the Tables) and in FIG. 7. Strong fluorescence derived from the antigen in the cells was observed in several Fc variants.

While not being restricted to a particular theory, this result can be explained as follows: the antigen and antibodies added to the cell culture solution form antigen-antibody complexes in the culture solution. The antigen-antibody complexes bind to hFcγRIIb expressed on the cell membrane via the antibody Fc region, and are taken up into the cells in a receptor-dependent manner. Ab1 used in this experiment is an antibody that binds to the antigen in a pH-dependent manner; therefore, the antibody can dissociate from the antigen. Since the dissociated antigen is labeled with pHrodoRed as described earlier, it fluoresces in the endosomes. Thus, a stronger fluorescence intensity inside the cell compared to the control is thought to indicate that the uptake of the antigen-antibody complexes into the cells is taking place more quickly or more frequently.

Here, a ratio of above about 1.05 fold or more of the fluorescence intensity of the antigen taken up into the cells of the variants compared to the fluorescence intensity of Ab1H-P600 was considered to have charge effect on an antigen taken up into the cells. A ratio of above about 1.5 fold or more of the fluorescence intensity of the antigen taken up into the cells of the variants compared to the fluorescence intensity of Ab1H-P600 was considered to have a strong charge effect on an antigen taken up into the cells. Thus, the above results showed that by introducing the pI-increasing modification into the appropriate position in the Fc region, uptake into cells can be accelerated as compared to before introduction of the modification. An amino acid position modification that shows such effect is, for example, position 253, 254, 256, 258, 281, 282, 285, 286, 307, 309, 311, 315, 327, 330, 358, 384, 385, 387, 399, 400, 421, 433, or 434, according to EU numbering. Preferably, modification is at position 254, 258, 281, 282, 285, 309, 311, 315, 327, 330, 358, 384, 399, 400, 421, 433, or 434, according to EU numbering. An amino acid substitution introduced at such a position is preferably arginine or lysine. Without limitation, the position where an amino acid substitution is introduced in the constant region with the objective of increasing the pI of the antibody may be, for example, the amino acid residue at position 285 according to EU numbering. Alternatively, other examples may include an amino acid substitution of the amino acid residue at position 399 according to EU numbering.

Example 5

Production of Fc Variants with Enhanced FcRn Binding Under Acidic pH Conditions for Improving Retention in the Plasma Under the acidic pH condition in the endosomes, IgG antibodies taken up into cells are known to be returned to the plasma by binding to FcRn. Therefore, IgG antibodies generally have long plasma half-life compared to proteins that do not bind to FcRn. Methods that utilize this property to enhance plasma retention of antibodies by increasing their FcRn affinity under acidic pH conditions through the introduction of amino acid modifications in the antibody Fc region are known. Specifically, methods for improving plasma retention of an antibody by increasing its affinity for FcRn under acidic pH conditions through amino acid modifications, such as the M252Y/S254T/T256E (YTE) modification (Dall'Acqua et al., *J. Biol. Chem.* 281:23514-23524 (2006)), M428L/N434S (LS) modification (Zalevsky et al., *Nat. Biotechnol.* 28:157-159 (2010)), and N434H modification (Zheng et al., *Clinical Pharmacology & Therapeutics* 89(2):283-290 (2011)) are known.

On the other hand, as described above, Fc variants with increased FcRn affinity under acidic pH conditions are also known to show undesired affinity towards the rheumatoid factor (RF) (WO2013/046704). Therefore, the following examinations were carried out with an objective of producing Fc variants that can improve plasma retention with decreased or substantially no binding to rheumatoid factor.
(5-1) Production of Novel Fc Region Variant-Containing Antibodies Fc variants with increased FcRn affinity under acidic pH conditions such as those including the known modifications, YTE, LS, or N434H, and several novel Fc variants (F1847m, F1848m, F1886m, F1889m, F1927m, and F1168m) were produced as shown below.

Sequences encoding heavy chains to which amino acid modifications were introduced in the Fc region of the heavy chain (VH3-IgG1m) of Fv4-IgG1, which is an anti-human IL-6 receptor antibody, were produced by the method of Reference Example 1. These heavy chains were used to produce the following antibodies by the method of Reference Example 2: (a) Fv4-IgG1 comprising VH3-IgG1m (SEQ ID NO:46) as the heavy chain and VL3-CK as the light chain; (b) Fv4-YTE comprising VH3-YTE (SEQ ID NO:47) as the heavy chain and VL3-CK as the light chain; (c) Fv4-LS comprising VH3-LS (SEQ ID NO:48) as the heavy chain and VL3-CK as the light chain; (d) Fv4-N434H comprising VH3-N434H (SEQ ID NO:49) as the heavy chain and VL3-CK as the light chain; (e) Fv4-F1847m comprising VH3-F1847m (SEQ ID NO:50) as the heavy chain and VL3-CK as the light chain; (f) Fv4-F1848m comprising VH3-F1848m (SEQ ID NO:51) as the heavy chain and VL3-CK as the light chain; (g) Fv4-F1886m comprising VH3-F1886m (SEQ ID NO:52) as the heavy chain and VL3-CK as the light chain; (h) Fv4-F1889m comprising VH3-F1889m (SEQ ID NO:53) as the heavy chain and VL3-CK as the light chain; (i) Fv4-F1927m comprising VH3-F1927m (SEQ ID NO:54) as the heavy chain and VL3-CK as the light chain; and (j) Fv4-F1168m comprising VH3-F1168m (SEQ ID NO:55) as the heavy chain and VL3-CK as the light chain.

(5-2) Kinetic Analyses of Binding Toward Human FcRn

Antibodies containing VH3-IgG1m or an above-mentioned variant as the heavy chain and L(WT) (SEQ ID NO:37) as the light chain were produced by the method of Reference Example 2, and the binding activity toward human FcRn was evaluated as follows.

Kinetic analyses of human FcRn and each of the antibodies were carried out using BIACORE T100 (GE Healthcare). An appropriate amount of Protein L (ACTIGEN) was fixed onto Sensor chip CM4 (GE Healthcare) by the amine coupling method to capture the antibodies of interest. Next, human FcRn was made to interact with the antibodies captured on the sensor chip by injecting a diluted FcRn solution and a running buffer (used as a reference solution). For the running buffer, 50 mM sodium phosphate, 150 mM NaCl, and 0.05% (w/v) Tween 20 at pH 6.0 was used, and the respective buffer was also used to dilute FcRn. To regenerate the sensor chip, 10 mM glycine-HCl at pH 1.5 was used. All measurements were carried out at 25° C. KD (M) for human FcRn was calculated for each antibody based on the association rate constant ka (1/Ms) and dissociation rate constant kd (1/s), which are kinetic parameters calculated from sensorgrams obtained by the measurements. The BIACORE T100 Evaluation Software (GE Healthcare) was used to calculate each parameter.

The results are shown in Table 8.

TABLE 8

| Variant Name | Amino Acid Mutation(s) | KD Value (nM) for hFcRn at pH 6.0 |
| --- | --- | --- |
| IgG1 | | 1382 |
| LS | M428L/N434S | 116 |
| YTE | M252Y/S254T/T256E | 148 |
| F1847m | N434A/Y436T/Q438R/S440E | 367 |
| F1848m | N434A/Y436V/Q438R/S440E | 295 |
| F1886m | M428L/N434A/Y436T/Q438R/S440E | 108 |
| F1889m | M428L/N434A/Y436V/Q438R/S440E | 103 |
| F1927m | M428L/N434A/Q438R/S440E | 125 |
| F1168m | N434A/Q438R/S440E | 410 |

Example 6

Evaluation of the Affinity of Fc Region Variant-Containing Antibodies with Enhanced FcRn Binding Under Acidic pH Conditions Toward the Rheumatoid Factor Anti-drug antibodies (ADAs) affect the efficacy and pharmacokinetics of therapeutic antibodies, and lead to serious side-effects at times; therefore, clinical utility and efficacy of therapeutic antibodies may be limited by production of ADAs. Many factors influence the immunogenicity of therapeutic antibodies, and the presence of effector T cell epitopes is one factor. In addition, the presence of ADA in a patient before administration of the therapeutic antibody (also called "Pre-existing ADA") may have similar problems. Specifically, in the case of therapeutic antibodies for patients with autoimmune diseases such as rheumatoid arthritis (RA), rheumatoid factor (RF) which is an autoantibody against human IgG may cause a "pre-existing ADA" problem. Recently, a humanized anti-CD4 IgG1 antibody having an N434H (Asn434His) mutation was reported to induce significant rheumatoid factor binding (Zheng et al., *Clinical Pharmacology & Therapeutics* 89(2):283-290 (2011)). Detailed studies confirmed that the N434H mutation in human IgG1 increases binding of the rheumatoid factor to the Fc region of antibodies as compared to that of the parent human IgG1.

The rheumatoid factor is a polyclonal autoantibody against human IgG, and its epitopes in human IgG differ depending on the clone and seem to be positioned in the CH2/CH3 interface region, and in the CH3 domain that may overlap with the FcRn-binding epitope. Therefore, mutations that increase the binding activity (binding affinity) towards FcRn may increase the binding activity (binding affinity) towards specific clones of the rheumatoid factor.

In fact, regarding Fc with increased affinity for FcRn at acidic pH or neutral pH, not only the N434H modification but many other amino acid modifications are also known to similarly increase the binding of the Fc to rheumatoid factor (WO2013/046704).

On the other hand, several amino acid modifications that selectively suppress the affinity toward the rheumatoid factor while not affecting affinity toward FcRn have been presented as examples in WO2013/046704, and among them, combinations of two amino acid mutations, namely Q438R/S440E, Q438R/S440D, Q438K/S440E, and Q438K/S440D, have been indicated. Accordingly, Q438R/S440E was introduced to Fc with novel increased affinity under acidic pH conditions first disclosed herein to examine whether binding toward rheumatoid factors can be decreased.

(6-1) Rheumatoid Factor Binding Assay of Fc Region Variant-Containing Antibodies A binding assay toward rheumatoid factor was performed by utilizing electrochemiluminescence (ECL) at pH 7.4 using individual sera (Proteogenex) from 30 RA patients. A 50-fold diluted serum sample, a biotinylated test antibody (1 µg/mL), and a SULFO-TAG NHS Ester (Meso Scale Discovery)-labeled test antibody (1 µg/mL) was each mixed and incubated at room temperature for three hours. Thereafter, the mixture was added to a Streptavidin-coated MULTI-ARRAY 96-well plate (Meso Scale Discovery), and the plate was incubated at room temperature for two hours and then washed. After adding Read Buffer T(×4) (Meso Scale Discovery) to each well, the plate was immediately set on the SECTOR imager 2400 Reader (Meso Scale Discovery), and chemiluminescence was measured.

The results of this assay are shown in FIGS. 8 to 17. Fv4-IgG1 (FIG. 8) which has a native human IgG1 only showed weak binding to the rheumatoid factor, whereas the existing Fc variants with increased FcRn binding, Fv4-YTE (FIG. 9), Fv4-LS (FIG. 10), and Fv4-N434H (FIG. 11), all showed significantly increased rheumatoid factor binding in a number of donors. On the other hand, all novel Fc region variants with increased FcRn binding, Fv4-F1847m (FIG. 12), Fv4-F1848m (FIG. 13), Fv4-F1886m (FIG. 14), Fv4-F1889m (FIG. 15), Fv4-F1927m (FIG. 16), and Fv4-F1168m (FIG. 17), showed only weak rheumatoid factor binding, and this showed that binding to the rheumatoid factor as a result of modifications to increase FcRn binding was significantly inhibited.

Figure 18:
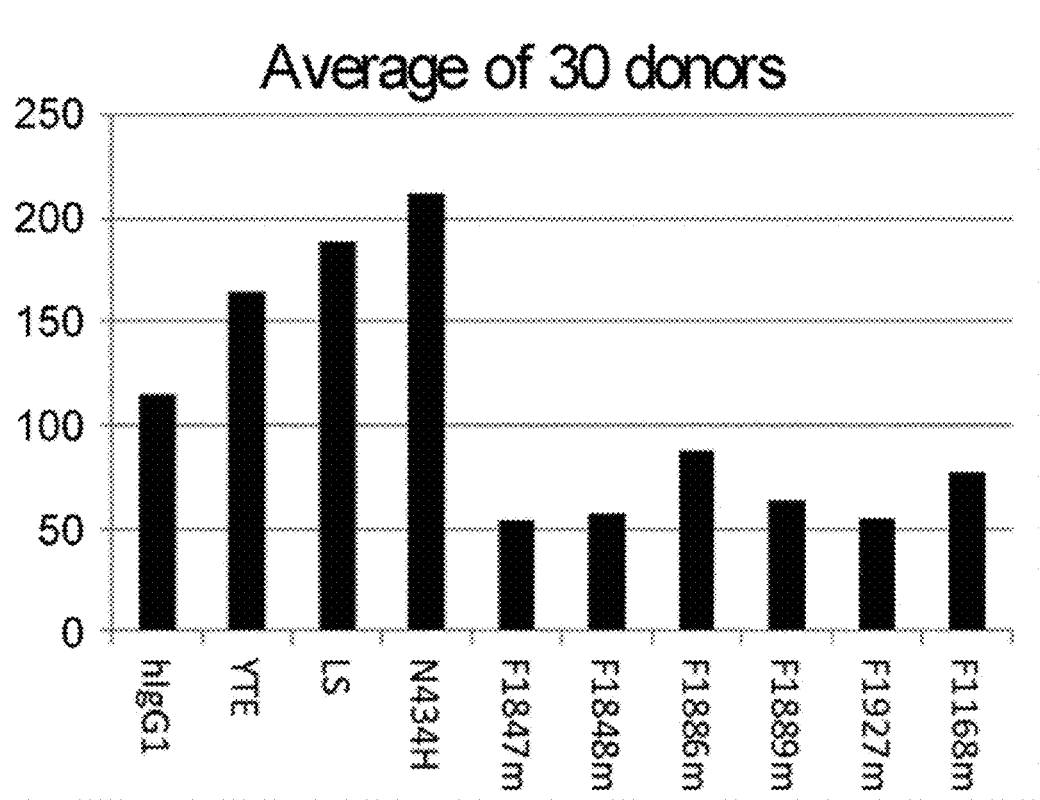
FIG. 18 shows average values of the binding of Fv4-IgG1, which has the Fc region of a native human IgG1, and each of the antibodies comprising a novel Fc region variant in which the Fc region has an Fc region variant with increased binding to each FcRn, to rheumatoid factor in the serum of RA patients.

FIG. 18 shows the average values of rheumatoid factor-binding affinity in the serum of 30 RA patients for each of the variants. All of the six new variants showed a lower affinity than the three pre-existing variants (YTE, LS, and N434H), and they also showed a lower affinity toward the rheumatoid factor as compared with native human IgG1. As such, when considering clinical development of therapeutic antibodies with improved affinity towards FcRn for autoimmune diseases such as rheumatoid arthritis and the like, the risk associated with the rheumatoid factor, which is of concern in existing Fc variants, was suppressed in the Fc variants first disclosed herein, and accordingly they may be used more safely than existing known Fc variants.

Example 7

PK Evaluation of the Fc Variants with Increased FcRn Binding Under Acidic pH Conditions in Cynomolgus Monkeys In Example 7, the effect of improving plasma retention in cynomolgus monkeys was evaluated by the following method using novel Fc region variant-containing antibodies provided herein whose binding to rheumatoid factor was confirmed to be suppressed.

(7-1) Production of Novel Fc Region Variant-Containing Antibodies

The following anti-human IgE antibodies were produced: (a) OHB-IgG1 comprising OHBH-IgG1 (SEQ ID NO:56) as the heavy chain and OHBL-CK (SEQ ID NO:57) as the light chain; (b) OHB-LS comprising OHBH-LS (SEQ ID NO:58) as the heavy chain and OHBL-CK as the light chain; (c) OHB-N434A comprising OHBH-N434A (SEQ ID NO:59) as the heavy chain and OHBL-CK as the light chain; (d) OHB-F1847m comprising OHBH-F1847m (SEQ ID NO:60) as the heavy chain and OHBL-CK as the light chain; (e) OHB-F1848m comprising OHBH-F1848m (SEQ ID NO:61) as the heavy chain and OHBL-CK as the light chain; (f) OHB-F1886m comprising OHBH-F1886m (SEQ ID NO:62) as the heavy chain and OHBL-CK as the light chain; (g) OHB-F1889m comprising OHBH-F1889m (SEQ ID NO:63) as the heavy chain and OHBL-CK as the light chain; and (h) OHB-F1927m comprising OHBH-F1927m (SEQ ID NO:64) as the heavy chain and OHBL-CK as the light chain.

(7-2) Monkey PK Assay on Novel Fc Region Variant-Containing Antibodies

The in vivo kinetics of anti-human IgE antibodies in the plasma after administration of the anti-human IgE antibodies to cynomolgus monkeys were evaluated. The anti-human IgE antibody solution was intravenously administered once at 2 mg/kg. Blood collection was performed five minutes, (two hours), seven hours, one day, two days, three days, (four days), seven days, 14 days, 21 days, 28 days, 35 days, 42 days, 49 days, and 56 days after administration. The collected blood was immediately subjected to centrifugation at 4° C. and 15,000 rpm for 5 minutes to obtain plasma. The separated plasma was stored in a freezer set to −80° C. or lower until performing the measurements. Eight types of anti-human IgE antibodies, namely OHB-IgG1, OHB-LS, OHB-N434A, OHB-F1847m, OHB-F1848m, OHB-F1886m, OHB-F1889m, and OHB-F1927m, were used.

(7-3) Measurement of the Anti-Human IgE Antibody Concentration in the Plasma by ELISA The concentration of anti-human IgE antibodies in the plasma of cynomolgus monkeys was measured by ELISA. First, an anti-human IgG kappa chain antibody (Antibody Solution) was dispensed into a Nunc-Immuno Plate, MaxiSorp (Nalge Nunc International) and allowed to stand overnight at 4° C. to produce an anti-human IgG kappa chain antibody-immobilized plate. Calibration curve samples having a plasma concentration of 640, 320, 160, 80, 40, 20 or 10 ng/mL, and cynomolgus monkey plasma measurement samples diluted 100-fold or more were prepared. These calibration curve samples and plasma measurement samples were produced such that cynomolgus monkey IgE (product prepared within the company) was added at a concentration of 1 ng/mL. Subsequently, the samples were dispensed into the anti-human IgG kappa chain antibody-immobilized plate, and allowed to stand at room temperature for two hours. Then, an HRP-anti human IgG gamma chain antibody (Southern Biotech) was dispensed, and allowed to stand at room temperature for one hour. Subsequently, a chromogenic reaction was carried out using the TMB Chromogen Solution (Life Technologies) as a substrate, and after stopping the reaction by adding 1N sulfuric acid (Wako), the absorbance at 450 nm was measured by a microplate reader. The concentration of anti-human IgE antibody in the monkey plasma was calculated from absorbance of the calibration curve using the analytical software SOFTmax PRO (Molecular Devices). The measured change in the concentration of anti-human IgE antibody in the monkey plasma is shown in FIG. 19. From the measured change in the concentration of anti-human IgE antibody in the monkey plasma, elimination clearance was calculated by moment analysis using Phoenix WinNonlin Ver. 6.2 (Pharsight Corporation). The calculated pharmacokinetic parameters are shown in Table 9. Samples from individuals who were positive for antibodies against the administered sample in plasma were excluded from the calculation of the change in the anti-human IgE antibody concentration and clearance in monkey plasma.

TABLE 9

Elimination Clearance of Administered Sample after Anti-Human IgE Antibody Administration

| Sample Name | Elimination Clearance (mL/day/kg) |
|---|---|
| OHB-IgG1 | 9.33 |
| OHB-F1847m | 2.83 |
| OHB-F1848m | 4.02 |
| OHB-F1886m | 1.92 |
| OHB-F1889m | 2.39 |
| OHB-F1927m | 1.51 |
| OHB-LS | 1.80 |
| OHB-N434A | 4.36 |

(7-4) Measurement of Antibodies Against the Administered Samples in Plasma by the Electrochemiluminescence Method Antibodies in monkey plasma against the administered samples were measured by an electrochemiluminescence method. An administered sample that was ruthenium-labeled using SULFO-TAG NHS Ester (Meso Scale Discovery), an administered sample that was biotinylated using EZ-Link Micro Sulfo-NHS-Biotinylation Kit (Pierce), and a cynomolgus monkey plasma measurement sample were mixed in equal amounts, and were left to stand overnight at 4° C. The samples were added to a MULTI-ARRAY 96-well Streptavidin Gold Plate (Meso Scale Discovery), then allowed to react at room temperature for two hours, and washed. Then, immediately after Read Buffer T(×4) (Meso Scale Discovery) was dispensed into the plate, measurements were carried out using SECTOR Imager 2400 (Meso Scale Discovery).

As a result, all of the novel Fc variants were confirmed to show greatly improved plasma retention in comparison to the Fc region of native IgG1.

(7-5) Mouse PK Assay on Fc Variants

The following experiment was carried out to compare F1718, which is an Fc variant described in WO2013/046704, and F1848m, which is an Fc variant newly discovered this time, as Fc variants for increasing FcRn binding at acidic pH.

Sequences encoding heavy chains into which amino acid modifications were introduced into the Fc region of the heavy chain (VH3-IgG1) of Fv4-IgG1(an anti-human IL-6 receptor antibody), were produced by the method of Reference Example 1. Using these heavy chains, the following antibodies were produced by the method of Reference Example 2: (a) Fv4-IgG1 comprising VH3-IgG1 as the heavy chain and VL3-CK as the light chain; and (b) Fv4-F1718 comprising VH3-F1718 (SEQ ID NO:65) as the heavy chain and VL3-CK as the light chain.

The above-mentioned anti-human IL-6 receptor antibodies were administered once at 1 mg/kg into the tail vein of human FcRn transgenic mice (B6.mFcRn−/−.hFcRn Tg line 32+/+ mouse; Jackson Laboratories, *Methods Mol. Biol.* 602:93-104 (2010). Blood was collected 15 minutes, seven hours, one day, two days, three days, seven days, 14 days, 21 days, and 28 days after administration of the anti-human IL-6 receptor antibodies. The collected blood was immediately centrifuged at 15,000 rpm and 4° C. for 15 minutes to obtain plasma. The separated plasma was stored in a freezer at −20° C. or below until measurements were taken.

(7-6) Measurement of the Anti-Human IL-6 Receptor Antibody Concentration in Plasma by ELISA The concentration of anti-human IL-6 receptor antibodies in the mouse plasma was measured by ELISA. First, an Anti-Human IgG (gamma-chain specific) F(ab')$_2$ Fragment of Antibody (SIGMA) was dispensed into a Nunc-Immuno Plate, MaxiSorp (Nalge nunc International) and allowed to stand overnight at 4° C. to produce an anti-human IgG immobilized plate. Calibration curve samples containing an anti-human IL-6 receptor antibody at a plasma concentration of 0.8, 0.4, 0.2, 0.1, 0.05, 0.025, or 0.0125 μg/mL and mouse plasma measurement samples diluted 100-fold or more were each prepared. 200 μL of 20 ng/mL soluble human IL-6 receptor was added to 100 μL of the calibration curve samples or the plasma measurement samples, and then the mixed solutions were allowed to stand for one hour at room temperature. Subsequently, the mixed solutions were dispensed into each well of the anti-human IgG-immobilized plate, and the plate was allowed to stand for one hour at room temperature. Then, a Biotinylated Anti-Human IL-6R Antibody (R&D) was added to react for one hour at room temperature. Subsequently, Streptavidin-PolyHRP80 (Stereospecific Detection Technologies) was added to react for one hour at room temperature, and chromogenic reaction of this reaction solution was carried out using TMB One Component HRP Microwell Substrate (BioFX Laboratories) as a substrate. After stopping the reaction by adding 1 N sulfuric acid (Showa Chemical), the absorbance at 450 nm of the reaction solution in each well was measured on a microplate reader. The antibody concentration in mouse plasma was calculated from the absorbance of the calibration curve using the analytical software SOFTmax PRO (Molecular Devices).

The results are shown in FIG. 20. F1718, which is an Fc variant for increasing FcRn binding at acidic pH described in WO2013/046704, did not show any effect of prolonging antibody PK, but showed plasma retention equivalent to that of native IgG1.

F1718 has four mutations, namely N434Y/Y436V/Q438R/S440E, introduced in the Fc region. By contrast, F1848m, first disclosed herein, has been introduced with four mutations, namely N434A/Y436V/Q438R/S440E. The only difference between the amino acid mutations introduced in these two types of Fc's is that the amino acid mutation introduced at position 434 according to EU numbering is Y (tyrosine) in F1718 and A (alanine) in F1848m. In Example (7-2), F1848m showed improved plasma retention compared to that of the native IgG1, whereas F1718 did not show any improvement in plasma retention. Therefore, without limitation, this suggests that A (alanine) is preferred as the amino acid mutation to be introduced at position 434 for improving plasma retention.

(7-7) Predicted Immunogenicity Score of Fc Variants

Generation of anti-drug antibodies (ADA) influences the efficacy and pharmacokinetics of therapeutic antibodies, and brings about serious side effects in some cases; and therefore, clinical utility and drug efficacy of therapeutic antibodies may be limited by the generation of ADA. The immunogenicity of therapeutic antibodies is known to be affected by many factors, and in particular, the importance of effector T cell epitopes carried by the therapeutic antibodies in particular has been reported many times.

In silico tools for predicting T cell epitopes such as Epibase (Lonza), iTope/TCED (Antitope), and EpiMatrix (EpiVax) have been developed. Using these in silico tools, T cell epitopes in each of the amino acid sequences can be predicted (Walle et al., *Expert Opin. Biol. Ther.* 7(3):405-418 (2007)), and the potential immunogenicity of therapeutic antibodies can be evaluated.

EpiMatrix was used to calculate the immunogenicity scores of evaluated Fc variants. EpiMatrix is a system for predicting the immunogenicity of a protein of interest by automatically designing sequences of peptide fragments by sectioning the amino acid sequence of the protein to be predicted for its immunogenicity by nine amino acids, and then calculating their ability to bind eight major MHC Class II alleles (DRB1*0101, DRB1*0301, DRB1*0401, DRB1*0701, DRB1*0801, DRB1*1101, DRB1*1301, and DRB1*1501) (*Clin. Immunol.* 131(2): 189-201 (2009)).

F1718 and F1756 (N434Y/Y436T/Q438R/S440E) described in WO2013/046704 contain a N434Y mutation. In contrast, newly disclosed F1848m and F1847m contain a N434A mutation.

The immunogenicity scores of these four variants, namely F1718, F1848m, F1756 and F1847m, which were calculated as described above, are shown in the "EpiMatrix Score" column of Table 31. Furthermore, regarding the EpiMatrix Scores, immunogenicity scores corrected for the Tregitope content are shown in the "tReg Adjusted Epx Score" column. Tregitope is a peptide fragment sequence present in large amounts mainly in naturally-occurring antibody sequences, and is a sequence considered to inhibit immunogenicity by activating suppressive T cells (Treg).

TABLE 31

| Protein Sequence | Mutations | EpiMatrix Score | tReg Adjusted Epx Score |
| --- | --- | --- | --- |
| F1718 | N434Y/Y436V/Q438R/S440E | −10.97 | −32.64 |
| F1848m | N434A/Y436V/Q438R/S440E | −15.38 | −37.06 |
| F1756 | N434Y/Y436T/Q438R/S440E | −14.05 | −35.73 |
| F1847m | N434A/Y436T/Q438R/S440E | −18.4 | −40.08 |

According to these results, both the "EpiMatrix Score" and the "tReg Adjusted Epx Score" showed that the immunogenicity scores of N434A variants F1848m and F1847m were decreased as compared to that of N434Y variants. This suggests that A (alanine) is preferred as the amino acid mutation to be introduced at position 434 for the lower immunogenicity scores.

Example 8

Production of Humanized Anti-Human IL-8 Antibodies (8-1) Production of the Humanized Anti-Human IL-8 Antibody hWS-4

Humanized anti IL-8 antibodies disclosed in U.S. Pat. No. 6,245,894 bind to human IL-8 (hIL-8) and block its physiological function. Modified humanized anti-IL-8 antibodies can be produced by combining the variable region sequences of the heavy and light chains disclosed in U.S. Pat. No. 6,245,894 with virtually any of the various known human antibody constant region sequences. Thus, the human antibody constant region sequences of these modified antibodies are not particularly limited, but native human IgG1 sequences or native human IgG4 sequences may be used as the heavy chain constant regions, and native human Kappa sequences can be used as the light chain constant region sequence.

From among the humanized IL-8 antibodies disclosed in U.S. Pat. No. 6,245,894, the coding sequence of hWS4H-IgG1 (SEQ ID NO:83) was combined the heavy chain variable region RVHg and the native human anti-IgG1 sequence for the heavy chain constant region was produced by the method of Reference Example 1. Furthermore, the coding sequence of hWS4L-k0MT (SEQ ID NO:84) which was combined the light chain variable region RVLa and the native human Kappa sequence for the light chain constant region was produced by the method of Reference Example 1. An antibody which was combined the above heavy chain and light chain was produced, and was named the humanized WS-4 antibody (hereinafter, hWS-4).

(8-2) Production of Humanized Anti-Human IL-8 Antibody Hr9

A new humanized antibody was produced using human consensus framework sequences that are different from the FRs used in hWS-4.

Specifically, a hybrid sequence of VH3-23 and VH3-64 was used as the heavy chain FR1, a sequence seen in VH3-15 and VH3-49 was used as FR2, a sequence seen in VH3-72 was used as FR3 (provided that 82a according to Kabat numbering is excluded), and a sequence seen in JH1 was used as FR4. These sequences were linked to the CDR sequences of the hWS-4 heavy chain to produce Hr9-IgG1 (SEQ ID NO:85), a novel humanized antibody heavy chain.

Next, two types of antibodies were produced, namely, hWS-4 having hWS-4H-IgG1 as the heavy chain and hWS4L-k0MT as the light chain, and Hr9 having Hr9-IgG1 as the heavy chain and hWS4L-k0MT as the light chain. Within the scope of Disclosure C described herein, when referring to the light chain in particular, Hr9 is written as Hr9/hWS4L. The antibodies were expressed using FreeStyle 293F cells (Invitrogen) according to the protocol attached to the product. Antibodies were purified from the culture supernatant by the method of Reference Example 2. As a result, antibodies were obtained in the amounts shown in Table 11. Surprisingly, the expression level of Hr9 was approximately 8 times the expression level of hWS-4.

TABLE 11

| | Antibody Yield per 1 mL Medium (µg) |
|---|---|
| hWS-4 | 6.4 |
| Hr9 | 50 |

(8-3) Human IL-8-Binding Activities of hWS-4 and Hr9

Binding affinities of hWS-4 and Hr9 towards human IL-8 were determined as follows using BIACORE T200 (GE Healthcare).

A running buffer having the composition of 0.05% tween 20, 20 mM ACES, and 150 mM NaCl (pH 7.4) was used. An appropriate amount of Protein A/G (PIERCE) was immobilized onto Sensor chip CM4 (GE Healthcare) by the amine coupling method and the antibody of interest was captured. Next, human IL-8 was made to interact with the antibody captured on the sensor chip by injecting a diluted human IL-8 solution and a running buffer (used as a reference solution). For the running buffer, the solution having the above-described composition was used, and this buffer was also used to dilute human IL-8. To regenerate the sensor chip, 10 mM glycine-HCl at pH 1.5 was used. All measurements were carried out at 37° C. KD (M) of each antibody for human IL-8 was calculated based on the association rate constant kon (1/Ms) and dissociation rate constant koff (1/s), which are kinetic parameters calculated from sensorgrams obtained by the measurements. The BIACORE T200 Evaluation Software (GE Healthcare) was used to calculate each parameter.

The results are shown in Table 12. hWS-4 and Hr9 were confirmed to have equivalent binding affinities toward human IL-8.

TABLE 12

| Antibody Name | kon (1/Ms) | koff (1/s) | KD (M) |
|---|---|---|---|
| hWS-4 | 9.74E+05 | 2.03E−04 | 2.09E−10 |
| Hr9 | 1.11E+06 | 2.17E−04 | 1.95E−10 |

For development of antibody pharmaceuticals, the production level of antibody molecules is an important factor, and generally, a high production level is desirable. It is particularly notable that from the above-mentioned examination, a more appropriate human consensus framework-derived sequence was selected for combination with the HVR sequence of hWS-4, and yielded Hr9 which had an improved production level while maintaining the binding affinity toward human IL-8.

Example 9

Generation of Antibodies with pH-Dependent IL-8 Affinity (9-1) Production of Hr9-Modified Antibodies for Conferring pH Dependency Studies were carried out with the objective of conferring pH-dependent IL-8 affinity to the Hr9 antibody obtained in Example 8.

While not being bound by particular theory, antibodies having pH-dependent affinity towards IL-8 may show the following behavior in vivo. The antibodies administered to a living organism can bind strongly to IL-8 in an environment where neutral pH is maintained (for example, in plasma), and block its function. A portion of such IL-8/antibody complexes are taken up into cells by nonspecific interaction with the cell membrane (pinocytosis) (hereinafter, referred to as non-specific uptake). Under the acidic pH conditions in the endosomes, the binding affinities of the aforementioned antibodies toward IL-8 become weak, and therefore the antibodies dissociate from IL-8. Then, the antibodies that dissociated from IL-8 can return to the outside of the cell via FcRn. The aforementioned antibodies that returned to the outside of the cell (into the plasma) in this manner can bind again to another IL-8 and block its function. Antibodies having pH-dependent affinity towards IL-8 are thought to be capable of binding to IL-8 multiple times by the above-mentioned mechanism.

In contrast, an antibody that does not have the property possessed by the aforementioned antibody, an antibody molecule is capable of neutralizing an antigen only once, but cannot neutralize the antigen multiple times. Generally, since an IgG antibody has two Fabs, a single antibody molecule can neutralize two molecules of IL-8. On the other hand, antibodies which can bind to IL-8 multiple times could bind to IL-8 any number of times as long as they stay in the living body. For example, a single molecule of a pH-dependent IL-8-binding antibody that is taken up into cells ten times since being administered until being eliminated can neutralize a maximum of 20 molecules of IL-8. Therefore, an antibody that can bind multiple times to IL-8 has the advantage of being able to neutralize several IL-8 molecules even with a small amount of the antibody. From another viewpoint, an antibody that can bind multiple times to IL-8 has the advantage of being able to maintain a state of being able to neutralize IL-8 for a longer period of time than when the same amount of antibody which does not have the property possessed is administered. From yet another viewpoint, an antibody that can bind multiple times to IL-8 has the advantage of being able to block the biological activity of IL-8 more strongly than when the same amount of an antibody which does not have the property possessed is administered.

To achieve these advantages, amino acid modifications, mainly histidine, were introduced into the variable regions of Hr9-IgG1 and WS4L-k0MT with the objective of producing antibodies that can bind to IL-8 multiple times. Specifically, the variants shown in Table 13 were produced by the methods of Reference Examples 1 and 2.

Notations such as "Y97H" indicated in Table 13 show the position where the mutation is introduced as defined by Kabat numbering, the amino acid before introduction of the mutation, and the amino acid after introduction of the mutation. Specifically, when denoted as "Y97H", it shows that the amino acid residue at position 97 according to Kabat numbering has been substituted from Y (tyrosine) to H (histidine). Furthermore, when a combination of multiple amino acid substitutions is introduced, it is written in a manner such as "N50H/L54H".

containing the Y97H modification in the heavy chain all showed a decreased human IL-8-binding affinity at acidic pH as well as a decreased human IL-8-binding affinity at neutral pH.

TABLE 14-1

| Antibody Name | pH | kon (1/Ms) | koff (1/s) | KD (M) | kon Ratio (pH7.4/pH5.8) | koff Ratio (pH5.8/pH7.4) | KD Ratio (pH5.8/pH7 4) |
|---|---|---|---|---|---|---|---|
| Hr9 (Hr9/WS4L) | pH 7.4 | 8.59E+05 | 2.11E−04 | 2.46E−10 | 2.7 | 2.2 | 5.9 |
|  | pH 5.8 | 3.23E+05 | 4.69E−04 | 1.45E−09 |  |  |  |
| Hr9/L16 | pH 7.4 | 8.90E+05 | 9.57E−05 | 1.08E−10 | 22.8 | 2.1 | 46.8 |
|  | pH 5.8 | 3.91E+04 | 1.97E−04 | 5.04E−09 |  |  |  |
| H89/WS4L | pH 7.4 | 8.51E+05 | 7.65E−04 | 8.99E−10 | 5.2 | 9.5 | 49.8 |
|  | pH 5.8 | 1.62E+05 | 7.27E−03 | 4.48E−08 |  |  |  |
| H89/L12 | pH 7.4 | 5.95E+05 | 2.48E−04 | 4.17E−10 | 5.0 | 14.2 | 71.0 |
|  | pH 5.8 | 1.19E+05 | 3.52E−03 | 2.96E−08 |  |  |  |
| H89/L16 | pH 7.4 | 6.02E+05 | 4.21E−04 | 6.99E−10 | 5.0 | 10.0 | 50.3 |
|  | pH 5.8 | 1.20E+05 | 4.22E−03 | 3.51E−08 |  |  |  |
| H89/L63 | pH 7.4 | 5.37E+05 | 1.13E−04 | 2.10E−10 | 2.1 | 18.7 | 38.3 |
|  | pH 5.8 | 2.62E+05 | 2.10E−03 | 8.04E−09 |  |  |  |
| H89/L118 | pH 7.4 | 5.80E+05 | 2.13E−05 | 3.67E−11 | 3.2 | 180.3 | 585.0 |
|  | pH 5.8 | 1.79E+05 | 3.84E−03 | 2.15E−08 |  |  |  |

TABLE 13

| Antibody Name | Mutation Introduced into Heavy Chain | Mutation Introduced into Light Chain |
|---|---|---|
| Hr9/WS4L | None | None |
| Hr9/L16 | None | L54H |
| H89/WS4L | Y97H | None |
| H89/L12 | Y97H | N50H |
| H89/L16 | Y97H | L54H |

(9-2) pH-Dependent IL-8 Affinity

The human IL-8-binding affinity of the antibodies produced in Example 9-1 was determined as described below using BIACORE T200 (GE Healthcare). The following two running buffers were used: (1) 0.05% tween 20, 20 mM ACES, 150 mM NaCl, pH 7.4; and (2) 0.05% tween 20, 20 mM ACES, 150 mM NaCl, pH 5.8.

An appropriate amount of Protein A/G (PIERCE) was immobilized onto Sensor chip CM4 (GE Healthcare) by the amine coupling method and the antibodies of interest was captured. Next, human IL-8 was made to interact with the antibodies captured on the sensor chip by injecting a diluted human IL-8 solution and a running buffer (used as a reference solution). For the running buffer, any of the above-mentioned solutions was used, and the respective buffers were also used to dilute human IL-8. To regenerate the sensor chip, 10 mM glycine-HCl at pH 1.5 was used. All measurements were carried out at 37° C. KD (M) of each antibody for human IL-8 was calculated based on the association rate constant kon (1/Ms) and dissociation rate constant koff (1/s), which are kinetic parameters calculated from sensorgrams obtained by the measurements. The BIACORE T200 Evaluation Software (GE Healthcare) was used to calculate each parameter.

The results are shown in Table 14-1. First, compared to Hr9, Hr9/L16 which contains a L54H modification in the light chain had a slightly enhanced human IL-8-binding affinity at neutral pH (pH 7.4) but a lowered human IL-8-binding affinity at acidic pH (pH 5.8). On the other hand, anti-IL-8 antibodies (H89/WS4L, H89/L12, and H89/L16) produced by combining various light chains with H89

(9-3) Production and Evaluation of Modified Antibodies for Conferring pH Dependence Combinations of promising modifications found in 9-2 and new amino acid mutations were evaluated, and the following combinations were found as a result.

TABLE 14-2

| Antibody Name | Mutation(s) Introduced into Heavy Chain | Mutation(s) Introduced into Light Chain |
|---|---|---|
| H89/L63 | Y97H | N50H/L54H |
| H89/L118 | Y97H | N50H/L54H/Q89K |

The variants were produced by the methods of Reference Examples 1 and 2, and the binding affinity towards human IL-8 was evaluated by a method similar to that of Example 9-2.

The results are also shown in Table 14. H89/L63 which has H89-IgG1 (SEQ ID NO:86) as the heavy chain and L63-k0MT (SEQ ID NO:87) as the light chain showed a human IL-8-binding affinity at neutral pH (pH 7.4) equivalent to that of Hr9, and a decreased human IL-8-binding affinity at acidic pH (pH 5.8). Specifically, both the koff (dissociation rate constant) and KD (dissociation constant) of H89/L63 at pH5.8 were higher than those of Hr9. This means that under the acidic pH condition in the endosomes, H89/L63 has a property of readily releasing human IL-8.

Surprisingly H89/L118, which has H89-IgG1 as the heavy chain and L118-k0MT (SEQ ID NO:88) as the light chain, was found to have an enhanced human IL-8-binding affinity (KD) under neutral pH conditions as compared to that of Hr9, but a weakened human IL-8-binding affinity (KD) under acidic pH conditions as compared to that of Hr9. Without particular limitation, generally, when antibodies that can bind multiple times to antigens are used as a pharmaceutical product, the pH-dependent antigen-binding antibodies preferably have a strong binding affinity (small KD) so that they can strongly neutralize the antigens under neutral pH conditions (such as in plasma). On the other hand, the antibodies preferably have a large dissociation rate constant (koff) and/or a weak binding affinity (large KD) so that they can quickly release the antigens under acidic pH conditions (such as in the endosomes). In comparison to Hr9, H89/L118 had acquired favorable properties in both these neutral pH and acidic pH conditions.

Thus, useful amino acid modifications were identified for Hr9 such as Y97H for its heavy chain and N50H/L54H/Q89K for its light chain. While not being limited thereto, it has been shown that pH-dependent IL-8-binding antibodies that are superior as pharmaceuticals could be generated by introducing a single or a combination of multiple amino acid modifications selected from these modifications.

While not being bound by a particular theory, it is considered that an important factor when using a pH-dependent antigen-binding antibody as a pharmaceutical is whether or not the antibody administered to the body can release the antigen in the endosome. In this regard, a sufficiently weak binding (large dissociation constant (KD)) under acidic pH conditions or a sufficiently fast dissociation rate (large dissociation rate constant (koff)) is thought to be important. Therefore, it was examined in the following experiment whether the KD or koff of H89/L 118 obtained by BIACORE is sufficient for dissociating the antigen in the endosome in vivo.

Example 10

Production of High-Affinity Antibodies for Mouse PK Assay

Methods for confirming the effect of an antibody on the rate of human IL-8 elimination in mice are not particularly limited. In one instance, the method involves administering an antibody in a condition mixed with human IL-8 to mice and then comparing the rate of human IL-8 elimination from mouse plasma.

Here, the reference antibody to be used for the mouse PK assay desirably has a sufficiently strong binding affinity under both neutral pH and acidic pH conditions. Then, a search for modifications that confer Hr9 with high-affinity was conducted, and as a result H998/L63 having H998-IgG1 (SEQ ID NO:89) as the heavy chain and L63-kOMT as the light chain was created.

H998/L63 was used to evaluate the human IL-8-binding affinity by a method similar to that of Example 9-2. The resulting sensorgrams are shown in FIG. 21.

H998/L63 showed a surprisingly slow dissociation rate under both neutral pH and acidic pH conditions, and was shown to have stronger IL-8-binding affinity than Hr9. However, it is known that, due to the mechanical limits of BIACORE, analytical values such as dissociation rate constant (koff) and dissociation constant (KD) cannot be calculated accurately in such cases where the protein-protein interaction has a slow dissociation rate. As accurate analytical values could not be obtained for H998/L63, its analytical values are not shown here. However, it is confirmed from the results of the experiment that H998/L63 has very strong binding affinity at both neutral pH and acidic pH, and is suitable as an antibody to be used for comparison in mouse PK assays.

Example 11

Mouse PK Assay Using the pH-Dependent IL-8-Binding Antibody H89/L118

(11-1) Mouse PK Assay Using H89/L118

The rate of human IL-8 elimination in vivo was evaluated using H89/L118 produced in Example 9 and H998/L63 produced in Example 10.

After simultaneous administration of human IL-8 and anti-human IL-8 antibodies to mice (C57BL/6J, Charles river), pharmacokinetics of human IL-8 were evaluated. A mixed solution of human IL-8 and an anti-human IL-8 antibody (10 µg/mL and 200 µg/mL, respectively) was administered in a single dose at 10 mL/kg to the tail vein. At this time, since a sufficiently excessive amount of the anti-human IL-8 antibody is present with respect to human IL-8, almost all the human IL-8 is considered to be bound to the antibody. Blood was collected five minutes, two hours, four hours, seven hours, one day, two days, three days, seven days, 14 days, 21 days, and 28 days after the administration. The collected blood was immediately centrifuged at 15,000 rpm and 4° C. for 15 minutes to obtain plasma. The separated plasma was stored in a freezer set at −20° C. or below until measurements were taken.

(11-2) Measurement of the Human IL-8 Concentration in Plasma

The human IL-8 concentration in mouse plasma was determined by an electrochemiluminescence method. First, an anti-human IL-8 antibody (prepared in-house) comprising a mouse IgG constant region was dispensed into a MULTI-ARRAY 96-well Plate (Meso Scale Discovery), and was allowed to stand at room temperature for one hour. Then, a PBS-Tween solution containing 5% BSA (w/v) was used for blocking at room temperature for two hours to prepare an anti-human IL-8 antibody-immobilized plate. Calibration curve samples containing human IL-8 at a plasma concentration of 275, 91.7, 30.6, 10.2, 3.40, 1.13, or 0.377 ng/mL and mouse plasma measurement samples diluted 25-fold or more were prepared. The samples were mixed with hWS-4 and allowed to react overnight at 37° C. Subsequently, 50 µL of the mixed solutions were dispensed into each well of the anti-human IL-8 antibody-immobilized plate, and the solution was stirred at room temperature for one hour. The final concentration of hWS-4 was adjusted to 25 µg/mL. Then, after one hour of reaction with a Biotin Mouse Anti-Human Igκ Light Chain (BD Pharmingen) at room temperature, and then one hour of reaction with SULFO-TAG Labeled Streptavidin (Meso Scale Discovery) at room temperature, Read Buffer T (×1) (Meso Scale Discovery) was dispensed, and measurements were performed immediately with SECTOR Imager 2400 (Meso Scale Discovery). The human IL-8 concentration was calculated based on the response in the calibration curve using the analytical software, SOFT Max PRO (Molecular Devices).

The resulting data on the concentration of human IL-8 in plasma is shown in FIG. 22, and the values of human IL-8 clearance (CL) from mouse plasma are shown in Table 15.

TABLE 15

| | Human IL-8 CL (mL/d/kg) Antibody Name | |
|---|---|---|
| | H998/L63 | H89/L118 |
| #1 | 21.4 | 472.2 |
| #2 | 27.5 | 447.2 |
| #3 | 24.7 | 476.0 |
| Average (N = 3) | 24.5 | 465.1 |
| Standard Deviation | 3.0 | 15.6 |

As clear from FIG. 22, in comparison to human IL-8 administered simultaneously with H998/L63, human IL-8 administered simultaneously with H89/L118 was shown to be eliminated surprisingly quickly from mouse plasma.

Furthermore, CL values which quantitatively represent the rate of human IL-8 elimination from mouse plasma indicate that the rate of human IL-8 elimination was increased about 19-fold for H89/L118 as compared to H998/L63.

Without being bound by a particular theory, the following can be speculated from the obtained data. Most of the human IL-8 administered simultaneously with the antibody binds to the antibody in the plasma and exist in a complexed form. Human IL-8 bound to H998/L63 may exist in an antibody-bound state even under the acidic pH condition in the endosome, due to the antibody's strong affinity. Thereafter, H998/L63 may be returned to the plasma via FcRn while still in the human IL-8-complexed form; therefore, when this occurs, human IL-8 is also returned to the plasma at the same time. Therefore, most of the human IL-8 taken up into the cells again may be returned to the plasma. That is, the rate of elimination of human IL-8 from plasma decreases remarkably when H998/L63 is simultaneously administered. On the other hand, as described previously, human IL-8 taken into cells in a form complexed with H89/L118, a pH-dependent IL-8-binding antibody, may dissociate from the antibody under the acidic pH condition in the endosome. Human IL-8 dissociated from the antibody would be degraded after being transferred to the lysosome. Therefore, pH-dependent IL-8-binding antibodies can significantly accelerate the elimination of human IL-8 as compared to an IL-8-binding antibody such as H998/L63 which has strong binding affinity at both acidic pH and neutral pH.

(11-3) Mouse PK Assay with Increased Dose of H89/L118

Next, an experiment that verifies the effect of varying the dose of H89/L118 was carried out as follows. After simultaneous administration of human IL-8 and H89/L118 (2 mg/kg or 8 mg/kg) to mice (C57BL/6J, Charles river), pharmacokinetics of human IL-8 were evaluated. A mixed solution of human IL-8 (2.5 µg/mL) and an anti-human IL-8 antibody (200 µg/mL or 800 µg/mL) was administered to the tail vein in a single dose of 10 mL/kg. At this time, since a sufficiently excessive amount of the anti-human IL-8 antibody is present compared to human IL-8, almost all of the human IL-8 are considered to be bound to the antibody. Blood was collected five minutes, seven hours, one day, two days, three days, seven days, 14 days, 21 days, and 28 days after the administration. The collected blood was immediately centrifuged at 15,000 rpm and 4° C. for 15 minutes to obtain plasma. The separated plasma was stored in a freezer set at −20° C. or below until measurements were taken.

Measurement of the human IL-8 concentration in mouse plasma was carried out by a method similar to that of Example 11-2. The resulting data on the human IL-8 concentration in plasma is shown in FIG. 23, and the values for human IL-8 clearance (CL) from mouse plasma are shown in Table 16.

TABLE 16

| | Human IL-8 CL (mL/d/kg) Antibody Name | |
|---|---|---|
| | H89/L118 | H89/L118 |
| | Antibody Dose | |
| | 2 mg/kg | 8 mg/kg |
| #1 | 181.2 | 93.0 |
| #2 | 237 | 101.6 |
| #3 | 247 | 114.5 |
| Average (N = 3) | 221.8 | 103.0 |
| Standard Deviation | 35.6 | 10.8 |

As a result, it was confirmed that as compared to the group administered with 2 mg/kg of H89/L118, the group administered with 8 mg/kg of the antibody had an approximately 2-fold slower rate of human IL-8 elimination.

Herein below, the inventors describe contents surmised as one of possible factors that bring about the aforementioned results based on the scientific background, but the contents of the Disclosure C are not limited to the contents of the following discussion.

Among the antibodies that are returned from inside the endosome into the plasma via FcRn, it is preferable that the proportion of human IL-8-bound antibodies is low. With the focus on human IL-8 present in the endosome, it is desirable to have a high proportion of the free form not bound by an antibody. When human IL-8 is administered together with an antibody that does not have pH-dependent IL-8-affinity, most (nearly 100%) of the human IL-8 in the endosome is considered to exist in a form complexed with the antibody, and a small amount (close to 0%) is considered to be in the free form. On the other hand, when administered together with the pH-dependent IL-8-binding antibody (for example H89/L118), a certain proportion of human IL-8 should exist in a free form in the endosome. Hypothetically, the proportion of free form in this case can be understood as follows: [proportion of free human IL-8 in the endosome (%)]=[free human IL-8 concentration in the endosome]/[total human IL-8 concentration in the endosome]×100.

The proportion of free human IL-8 in the endosome as understood by the above equation is desirably higher, and for example, 20% is more preferable than 0%, 40% is more preferable than 20%, 60% is more preferable than 40%, 80% is more preferable than 60%, and 100% is more preferable than 80%.

Thus, there is a correlation between the proportion of free human IL-8 in the endosome described above and the binding affinity (KD) and/or dissociation rate constant (koff) for human IL-8 at acidic pH. That is, the weaker the binding affinity and/or the greater the dissociation rate for human IL-8 at acidic pH, the higher the proportion of free human IL-8 in the endosome. However, in the case of pH-dependent IL-8-binding antibodies which can make the proportion of free human IL-8 close to 100% in the endosome, further weakening the binding affinity and/or increasing the dissociation rate at acidic pH does not necessarily lead to an effective increase in the proportion of free human IL-8. One can easily understand that, for example, even if the proportion of free human IL-8 is improved from 99.9% to 99.99%, such a degree of improvement may not be significant.

Furthermore, according to the general chemical equilibrium theory, when an anti-IL-8 antibody and human IL-8 coexist and their binding reaction and dissociation reaction have reached an equilibrium, the proportion of free human IL-8 is unambiguously determined by three parameters: antibody concentration, antigen concentration, and dissociation constant (KD). Here, when the antibody concentration is high, when the antigen concentration is high, or when the dissociation constant (KD) is small, complexes are readily formed and the proportion of free human IL-8 decreases. On the other hand, when the antibody concentration is low, when the antigen concentration is low, or when the dissociation constant (KD) is large, complex formation becomes difficult, and the proportion of free human IL-8 increases.

Meanwhile, in this experiment, the rate of elimination of human IL-8 when H89/L118 was administered at 8 mg/kg was slower than when the antibody was administered at 2 mg/kg. This therefore suggests that in the endosome, the proportion of free human IL-8 was decreased when antibody was administered at 8 mg/kg compared to when the antibody was administered at 2 mg/kg. The reason for this decrease may be that increasing the antibody dosage by four-fold increased the antibody concentration in the endosome, and thereby facilitated formation of the IL-8-antibody complex in the endosome. That is, in the group administered with an increased dose of the antibody, the proportion of free human IL-8 in the endosome decreased, and therefore the rate of elimination of human IL-8 has been decreased. This also suggests that when the antibody is administered at 8 mg/kg, the degree of the dissociation constant (KD) of H89/L118 under acidic pH conditions is insufficient for bringing free human IL-8 to nearly 100%. More specifically, if it is an antibody that has a larger dissociation constant (KD) (weaker binding) under acidic pH conditions, it may achieve a state of nearly 100% free IL-8 even when the antibody is administered at 8 mg/kg, and a rate of human IL-8 elimination equivalent to that when the antibody is administered at 2 mg/kg.

Based on the above, to confirm whether the pH-dependent IL-8-binding antibody of interest can accomplish a proportion of nearly 100% free human IL-8 in the endosome, without being particularly limited, one can verify whether there is room for increasing the degree of the antigen-eliminating effect in vivo or not. For example, one method compares the rate of human IL-8 elimination when using a novel pH-dependent IL-8-binding antibody to that when H89/L118 is used, where the novel antibody has a weaker binding affinity at acidic pH and/or an increased dissociation rate at acidic pH compared to that of H89/L118. In case that the aforementioned novel pH-dependent IL-8-binding antibody shows an equivalent rate of human IL-8 elimination to that for H89/L118, this suggests that the binding affinity and/or dissociation rate of H89/L118 at acidic pH is already at a level sufficient for achieving a proportion of nearly 100% free human IL-8 in the endosome. On the other hand, in instances where the aforementioned novel pH-dependent IL-8-binding antibody shows a higher rate of human IL-8 elimination, this suggests that the binding affinity and/or dissociation rate of H89/L118 at acidic pH has room for improvement.

Example 12

Production and Evaluation of the pH-Dependent IL-8-Binding Antibody H553/L118

(12-1) Production of Antibody H553/L118 Having pH-Dependent IL-8 Binding Ability Here, the inventors aimed to generate antibodies that have an even weaker human IL-8-binding affinity under acidic pH conditions and/or a greater dissociation rate than those of H89/L118.

Amino acid modifications, mainly involving histidine, were introduced using H89/L118 as a base, to produce the modified antibodies shown in Table 17 by a method similar to that of Example 9. Furthermore, the human IL-8-binding affinity for these antibodies was determined by a method similar to that of Example 9-2.

Part of the results is shown in Table 17. The antibody H553/L118 comprising H553-IgG1 (SEQ ID NO:90) as the heavy chain and L118-k0MT as the light chain, and the antibody H496/L118 comprising H496-IgG1 (SEQ ID NO:101) as the heavy chain and L118-k0MT as the light chain were shown to have further increased pH dependency than H89/L118.

TABLE 17

| Antibody Name | pH | kon (1/Ms) | koff (1/s) | KD (M) | kon Ratio (pH7.4/pH5.8) | Koff Ratio (pH5.8/pH7.4) | KD Ratio (pH5.8/pH7.4) |
|---|---|---|---|---|---|---|---|
| H89/L118 | pH 7.4 | 9.45E+05 | 1.14E−04 | 1.21E−10 | | | |
| | pH 5.8 | 1.23E+05 | 3.90E−03 | 3.18E−08 | 7.7 | 34.2 | 263.0 |
| H496/L118 | pH 7.4 | 1.29E+06 | 5.03E−05 | 3.91E−11 | | | |
| | pH 5.8 | 1.78E+05 | 5.47E−03 | 3.07E−08 | 7.2 | 108.6 | 785.0 |
| H553/L118 | pH 7.4 | 1.15E+06 | 1.13E−04 | 9.76E−11 | | | |
| | pH 5.8 | 6.14E+05 | 3.05E−02 | 4.97E−08 | 1.9 | 270.7 | 509.3 |

In the obtained H553/L118, two amino acid modifications, Y55H and R57P, were introduced into the heavy chain of H89/L118. On the other hand, H496/L118, in which only R57P was introduced into the heavy chain of H89/L118, has an enhanced binding affinity for human IL-8 at neutral pH but a hardly changed human IL-8-binding affinity at acidic pH, in comparison to H89/L118. More specifically, the R57P modification introduced into H89/L118 is a modification that enhances the human IL-8-binding affinity only at neutral pH without changing the binding affinity at acidic pH. Furthermore, H553/L118 produced by introducing the Y55H modification into the heavy chain of H496/L118 has a maintained or slightly enhanced binding affinity at neutral pH, but on the other hand, a decreased binding affinity at acidic pH in comparison to those of H89/L118. That is, introducing a combination of the two amino acid modifications, Y55H and R57P, into H89/L118 enabled further enhancement of the property of decreasing the binding affinity at acidic pH, while maintaining or slightly enhancing the binding affinity at neutral pH.

(12-2) Mouse PK Assay Using H553/L118

Evaluation of the rate of human IL-8 elimination in mice using H553/L118 was carried out by a method similar to that of Example 11-2. The resulting data on the human IL-8 concentration in plasma is shown in FIG. 24, and the values of human IL-8 clearance (CL) from mouse plasma are shown in Table 18.

TABLE 18

| | Human IL-8 (mL/d/kg) Antibody Name | | | |
|---|---|---|---|---|
| | H89/L118 | H89/L118 | H553/L118 | H553/L118 |
| | Antibody Dose | | | |
| | 2 mg/kg | 8 mg/kg | 2 mg/kg | 8 mg/kg |
| #1 | 181.2 | 93.0 | 250 | 256.6 |
| #2 | 237 | 101.6 | 245 | 248.4 |
| #3 | 247 | 114.5 | 249 | 244.1 |
| Average (N = 3) | 221.8 | 103.0 | 248 | 249.7 |
| Standard Deviation | 35.6 | 10.8 | 3 | 6.4 |

As a result, large differences were not observed between H553/L118 and H89/L118 when the data of mice administered with 2 mg/kg antibody were compared; however, it was confirmed that H553/L118 accelerates the elimination of human IL-8 by 2.5 fold or so in comparison to H89/L118 when the data of mice administered with 8 mg/kg antibody were compared. From another viewpoint, H553/L118 did not show difference in the rate of human IL-8 elimination between 2 mg/kg and 8 mg/kg, and a reduction of the antigen elimination rate due to increase of the antibody dose as with H89/L118 was not observed.

Without particular limitation, one reason why such results were obtained may be discussed as follows. H533/L118 showed an equivalent rate of human IL-8 elimination when the antibody was administered at 2 mg/kg and at 8 mg/kg. This can indicate that the proportion of free IL-8 in the endosome can reach a level close to 100%, since the IL-8 binding by H553/L118 at acidic pH is sufficiently weak even under the conditions of 8 mg/kg-administration. In other words, this suggests that while H89/L118 can achieve a maximum human IL-8 elimination effect at a dose of 2 mg/kg, its effects may be weakened at a high dose of around 8 mg/kg. On the other hand, H553/L118 can achieve a maximum effect of eliminating human IL-8 even at a high dose of 8 mg/kg.

(12-3) Stability Evaluation Using H553/L118

H553/L118 was shown to be an antibody that can accelerate the elimination of human IL-8 more remarkably than H89/L118 in mice. However, in order for this antibody to sustain this inhibitory effect on human IL-8 for a long period of time in vivo, it is also important that the IL-8-neutralizing activity is stably kept (stability in IL-8-neutralizing activity of this antibody) during the period when the administered antibody is present in vivo (for example, in plasma). Accordingly, the stability of these antibodies in mouse plasma was evaluated by the following method.

Mouse plasma was collected from the blood of C57BL/6J (Charles River) by a method known in the art. 200 µL it of 200 mM PBS (Sigma, P4417) was added to 800 µL of mouse plasma to give 1 mL. Furthermore, sodium azide was added at a final concentration of 0.1% as an antiseptic. Then, each antibody (Hr9, H89/L118, and H553/L118) was added to the above-mentioned mouse plasma to a final concentration of 0.2 mg/mL. At this point, a portion of the sample was collected as the initial sample. The remaining sample was stored at 40° C. One week and two weeks after storage, a portion of each sample was collected, and they were used as the one-week-stored sample and the two-week-stored sample. All samples were frozen at −80° C. and stored until each analysis was performed.

Next, anti-IL-8 antibodies contained in mouse plasma were evaluated for their human IL-8-neutralizing activity as follows: CXCR1 and CXCR2 are known receptors for human IL-8. The PathHunter(r) CHO-K1 CXCR2 β-Arrestin cell line (DiscoveRx Co., Cat. #93-0202C2) expresses human CXCR2, and is a cell line artificially produced so as to emit chemiluminescence when human IL-8-mediated signals are transmitted. While it is not particularly limited, the human IL-8-neutralizing activity possessed by an anti-human IL-8 antibody can be evaluated using this cell. When human IL-8 is added to the culture solution of the cells, a certain amount of chemiluminescence is exhibited in a manner dependent on the concentration of the added human IL-8. When human IL-8 and an anti-human IL-8 antibody are added together to the culture solution, human IL-8 signal transduction may be blocked upon binding of the anti-human IL-8 antibody to human IL-8. As a result, chemiluminescence caused by addition of human IL-8 will be inhibited by the anti-human IL-8 antibody, and the chemiluminescence will be weaker than when the antibody is not added, or there will be no chemiluminescence at all. Therefore, as the human IL-8 neutralizing activity possessed by the antibody becomes stronger, the degree of chemiluminescence becomes weaker; and as the human IL-8 neutralizing activity possessed by the antibody becomes weaker, the degree of chemiluminescence becomes stronger.

This is the same for an antibody that has been added to mouse plasma and stored for a certain period of time. If the neutralizing activity of the antibody does not change due to storage in mouse plasma, the degree of the above-mentioned chemiluminescence before and after storage should not change. On the other hand, in the case of an antibody whose neutralizing activity decreases due to storage in mouse plasma, the degree of chemiluminescence by use of a stored antibody will increase as compared to that before storage.

Then, the above-mentioned cell line was used to examine whether the neutralizing activity of an antibody stored in mouse plasma was maintained. First, the cell line was suspended in the AssayComplete™ Cell Plating 0 Reagent, and then seeded into a 384-well plate at 5000 cells/well. One day after starting of the cell culture, an experiment was performed below for determining the concentration of human IL-8 to be added. Serially diluted human IL-8 solutions, which contain final human IL-8 concentrations from 45 nM (400 ng/mL) to 0.098 nM (0.1 ng/mL), were added to the cell culture solution. Next, a detection reagent was added according to the protocol of the product, and the relative chemiluminescence level was detected using a chemiluminescence detector. From this result, reactivity of the cells towards human IL-8 was confirmed, and the human IL-8 concentration suitable for confirming the neutralizing activity of anti-human IL-8 antibodies was determined. Here, the human IL-8 concentration was set to 2 nM.

Next, the aforementioned anti-human IL-8 antibody-added mouse plasma was used to evaluate the neutralizing activities of the antibodies contained therein. Human IL-8 at the concentration determined above and the aforementioned anti-human IL-8 antibody-containing mouse plasma were added to the cell culture. The amount of mouse plasma to be added was determined so as to contain stepwise concentrations of the anti-human IL-8 antibody in the range of 2 µg/mL (13.3 nM) to 0.016 µg/mL (0.1 nM). Next, detection reagents were added according to the product protocol, and the relative chemiluminescence levels were detected using a chemiluminescence detector.

Here, relative values for the relative chemiluminescence levels at each antibody concentration were calculated by defining the average relative chemiluminescence level in wells without addition of human IL-8 and antibody as 0%, and by defining the average relative chemiluminescence level in wells that have been added with only human IL-8 but no antibody as 100%.

The results of human IL-8 inhibition assay using human CXCR2-expressing cells are shown in FIG. 25A, which shows results from the initial sample (without preservative treatment in mouse plasma), FIG. 25B, which shows results for the samples stored at 40° C. for one week, and FIG. 25C, which shows results for the samples stored at 40° C. for two weeks.

As a result, differences in the human IL-8-neutralizing activity before and after storage in mouse plasma were not observed for Hr9 and H89/L118. On the other hand, H553/L118 showed decrease in the human IL-8-neutralizing activity after two-week storage. Therefore, the human IL-8- neutralizing activity of H553/L118 readily decreases in mouse plasma as compared to that of Hr9 and H89/L118, and H553/L118 was shown to be an antibody having unstable properties in terms of the IL-8 neutralizing activity.

Example 13

Production of Antibodies with Reduced Predicted Immunogenicity Score Using an in Silico System (13-1) Predicted Immunogenicity Score of Various IL-8-Binding Antibodies Generation of anti-drug antibodies (ADA) influences the efficacy and pharmacokinetics of therapeutic antibodies, and brings about serious side effects in some cases; and therefore, clinical utility and drug efficacy of therapeutic antibodies may be limited by the generation of ADA. The immunogenicity of therapeutic antibodies is known to be affected by many factors, and, there are many reports describing the importance of effector T cell epitopes in the therapeutic antibodies.

In silico tools for predicting T cell epitopes such as Epibase (Lonza), iTope/TCED (Antitope), and EpiMatrix (EpiVax) have been developed. Using these in silico tools, T cell epitopes in each of the amino acid sequences can be predicted (Walle et al., Expert Opin. Biol. Ther. 7(3):405-418 (2007)), and the potential immunogenicity of therapeutic antibodies can be evaluated.

Here, EpiMatrix was used to calculate the immunogenicity scores of each of the anti-IL-8 antibodies. EpiMatrix is a system for predicting the immunogenicity of a protein of interest by automatically designing sequences of peptide fragments by sectioning the amino acid sequence of the protein to be predicted for its immunogenicity by nine amino acids, and then calculating their ability to bind eight major MEW Class II alleles (DRB1*0101, DRB1*0301, DRB1*0401, DRB1*0701, DRB1*0801, DRB1*1101, DRB1*1301, and DRB1*1501) (De Groot et al., Clin. Immunol. 131(2):189-201 (2009)).

The immunogenicity scores of the heavy chains and light chains of each anti-IL-8 antibody, which were calculated as described above, are shown in the "EpiMatrix Score" column of Table 19. Furthermore, regarding the EpiMatrix Scores, immunogenicity scores corrected for the Tregitope content are shown in the "tReg Adjusted Epx Score" column. Tregitope is a peptide fragment sequence present in large amounts mainly in native antibody sequences, and is a sequence considered to inhibit immunogenicity by activating suppressive T cells (Tregs).

Furthermore, regarding these scores, the sum of the scores for the heavy and light chains is shown in the "Total" column.

According to these results, both the "EpiMatrix Score" and the "tReg Adjusted Epx Score" showed that the immunogenicity scores of H89/L118, H496/L118, and H553/L118 were decreased as compared to that of hWS-4, which is a known humanized anti-human IL-8 antibody.

Furthermore, with EpiMatrix, it is feasible to compare the frequency of ADA development predicted for the antibody molecule as a whole by considering the heavy-chain and light-chain scores with the actual frequency of ADA development caused by various commercially available antibodies. Results of performing such analysis are shown in FIG. 26. Due to system limitations, the notations used in FIG. 26 are "W54" for hWS-4, "HR9" for Hr9, "H89L118" for H89/L118, "H496L118" for H496/L118, and "H553L118" for H553/L118.

As shown in FIG. 26, the frequency of ADA development in humans caused by various commercially available antibodies is known to be 45% for Campath (Alemtuzumab), 27% for Rituxan (Rituximab), and 14% for Zenapax (Daclizumab). On the other hand, while the frequency of ADA development predicted from the amino acid sequence was 10.42% for hWS-4 which is a known humanized anti-human IL-8 antibody, the frequency of H89/L118 (5.52%), H496/L118 (4.67%), or H553/L118 (3.45%) newly identified herein were significantly lower in comparison to that of hWS-4.

(13-2) Production of Modified Antibodies with Lowered Predicted Immunogenicity Scores As described above, the immunogenicity scores of H89/L118, H496/L118, and H553/L118 were lower in comparison to that of hWS-4; however, as is apparent from Table 19, the immunogenicity scores for the heavy chain are higher than those for the light chains, which suggests that there is still room for improvement in the amino acid sequences of the heavy chain in particular from the viewpoint of immunogenicity. Then, a search was conducted in the heavy chain variable region of H496 for amino acid modifications that can decrease the immunogenicity score. As a result of diligent search, three variants, H496v1 in which alanine at position 52c according to Kabat numbering was substituted with aspartic acid, H496v2 in which glutamine at position 81 was substituted with threonine, and H496v3 in which serine at position 82b was substituted with aspartic acid were found. Furthermore, H1004 that contains all three of these modifications was produced.

The results of immunogenicity scores calculated by a method similar to that of Example 13-1 are shown in Table 20.

TABLE 19

| Antibody Name | Heavy Chain | | Light Chain | | Total | |
|---|---|---|---|---|---|---|
| | EpiMatrix Score | tReg Adjusted Epx Score | EpiMatrix Score | tReg Adjusted Epx Score | EpiMatrix Score | tReg Adjusted Epx Score |
| hWS-4 | 62.44 | 12.18 | 22.64 | −23.89 | 85.08 | −11.71 |
| Hr9 | 56.52 | 6.27 | 22.64 | −23.89 | 79.16 | −17.62 |
| H89/L118 | 57.99 | 7.74 | 7.16 | −39.36 | 65.15 | −31.62 |
| H496/L118 | 54.13 | 3.87 | 7.16 | −39.36 | 61.29 | −35.49 |
| H553/L118 | 47.88 | −2.37 | 7.16 | −39.36 | 55.04 | −41.73 |

TABLE 20

| Antibody Name | Heavy Chain | | Light Chain | | Total | |
|---|---|---|---|---|---|---|
| | EpiMatrix Score | tReg Adjusted Epx Score | EpiMatrix Score | tReg Adjusted Epx Score | EpiMatrix Score | tReg Adjusted Epx Score |
| H496/L118 | 54.13 | 3.87 | 7.16 | −39.36 | 61.29 | −35.49 |
| H496v1/L118 | 32.17 | −18.08 | 7.16 | −39.38 | 39.33 | −57.44 |
| H496v2/L118 | 45.26 | −5.00 | 7.16 | −39.36 | 52.42 | −44.36 |
| H496v3/L118 | 38.27 | −11.98 | 7.16 | −39.36 | 45.43 | −51.34 |
| H1004/L118 | 10.79 | −39.47 | 7.16 | −39.36 | 17.95 | −78.83 |
| H1004/L395 | 10.79 | −39.47 | 7.79 | −38.74 | 18.58 | −78.21 |

The three heavy chains, H496v1, H496v2, and H496v3, all of which contain a single modification, showed decreased immunogenicity scores in comparison to that of H496. Furthermore, H1004, that contains a combination of three modifications, achieved a remarkable improvement of the immunogenicity score.

Here, in addition to L118, L395 was identified as the light chain appropriate for combination with H1004. Therefore, in the calculation of immunogenicity scores, both the L118 combination and the L395 combination were used. As indicated in Table 20, H1004/L118 and H1004/L395, which are combinations of heavy and light chains, also showed very low immunogenicity scores.

Next, the frequency of ADA development for these combinations was predicted in a manner similar to Example 13-1. The results are shown in FIG. 27. The notations used in FIG. 27 are "V1" for H496v1/L118, "V2" for H496v2/L118, "V3" for H496v3/L118, "H1004L118" for H1004/L118, and "H1004L395" for H1004/L395.

Surprisingly, H1004/L118 and H1004/L395, which have remarkably lowered immunogenicity scores, also showed improvement in the predicted values for the frequency of ADA development, and showed a predicted value of 0%.

(13-3) Measurement of the IL-8-Binding Affinity of H1004/L395

H1004/L395 which is an antibody comprising H1004-IgG1m (SEQ ID NO:91) as the heavy chain and L395-kOMT (SEQ ID NO:82) as the light chain was produced. The binding affinity of H1004/L395 for human IL-8 was measured as described below using BIACORE T200 (GE Healthcare).

The following two running buffers were used, and measurements were carried out at the respective temperatures: (1) 0.05% tween 20, 40 mM ACES, 150 mM NaCl, pH 7.4, 40° C.; and (2) 0.05% tween 20, 40 mM ACES, 150 mM NaCl, pH 5.8, 37° C.

An appropriate amount of Protein A/G (PIERCE) was immobilized onto the Sensor chip CM4 (GE Healthcare) by the amine coupling method and the antibodies of interest were captured. Next, a diluted human IL-8 solution or a running buffer (used as a reference solution) was injected to allow interaction of the antibodies captured onto the sensor chip with human IL-8. For the running buffer, either one of the above-mentioned solutions was used, and the respective buffers were also used to dilute human IL-8. To regenerate the sensor chip, 25 mM NaOH and 10 mM glycine-HCl (pH 1.5) were used. KD (M) of each antibody for human IL-8 was calculated based on the association rate constant kon (1/Ms) and dissociation rate constant koff (1/s) which are kinetic parameters calculated from sensorgrams obtained by the measurements. The BIACORE T200 Evaluation Software (GE Healthcare) was used to calculate each parameter.

The measurement results are shown in Table 21. In comparison to H89/L118, H1004/L395, with lowered immunogenicity score, had an equivalent KD for human IL-8 at neutral pH, but increased KD and koff at acidic pH; and it was shown to have the property of dissociating readily from IL-8 in the endosome.

TABLE 21-1

| Antibody Name | pH | kon (1/Ms) | koff (1/s) | KD (M) | kon Ratio (pH7.4/ pH5.8) | koff Ratio (pH5.8/ pH7.4) | Kd Ratio (pH5.6/ pH7.4) |
|---|---|---|---|---|---|---|---|
| H89/L118 | pH 7.4 | 7.51E+05 | 1.29E−04 | 1.72E−10 | 5.8 | 48.7 | 283.7 |
| | pH 5.8 | 1.29E+05 | 6.28E−03 | 4.88E−08 | | | |
| H1004/L395 | pH 7.4 | 1.02E+06 | 1.55E−04 | 1.51E−10 | 3.3 | 218.1 | 728.5 |
| | pH 5.8 | 3.06E+05 | 3.38E−02 | 1.10E−07 | | | |

Example 14

Production and Evaluation of the pH-Dependent IL-8-Binding Antibody H1009/L395

(14-1) Production of Various pH-Dependent IL-8-Binding Antibodies

H1004/L395, which has pH-dependent IL-8 binding ability and also a lowered immunogenicity score was obtained by the evaluation shown in Example 13. Subsequently, a dedicated investigation was carried out to produce variants that have these favorable properties as well as stability in mouse plasma.

The following modified antibodies were produced based on H1004/L395 by introducing various modifications.

TABLE 21-2

Heavy Chain

| | |
|---|---|
| H1004 | A52cD/R57P/Q81T/S82bD/Y97H |
| H0932 | A52cD/G54H/Y55H/R57P/Q81T/S82bD/Y97H |
| H1000 | D31E/A52cD/G54H/Y55H/R57P/Q81T/S82bD/Y97H |
| H1009 | A52cD/G54Y/Y55H/R57P/Q81T/S82bD/Y97H |
| H1022 | A52cD/G54H/Y55H/T56H/R57P/Q81T/S82bD/Y97H |
| H1023 | A52cD/T56H/R57P/Q81T/S82bD/Y97H |
| H1028 | A52cD/G54Y/Y55H/T56H/R57P/Q81T/S82bD/Y97H |
| H1029 | S30D/D31K/A52cD/G54H/Y55H/R57P/Q81T/S82bD/Y97H |

TABLE 21-2-continued

| | Heavy Chain |
|---|---|
| H1031 | S30D/D31K/A52cD/G54H/Y55H/T56H/R57P/Q81T/S82bD/Y97H |
| H1032 | S30D/D31K/A52cD/T56H/R57P/Q81T/S82bD/Y97H |
| H1037 | S30D/D31K/A52cD/G54Y/Y55H/T56H/R57P/Q81T/S82bD/Y97H |
| H1040 | D31E/A52cD/G54H/Y55H/T56H/R57P/Q81T/S82bD/Y97H |
| H1041 | D31E/A52cD/T56H/R57P/Q81T/S82bD/Y97H |
| H1046 | D31E/A52cD/G54Y/Y55H/T56H/R57P/Q81T/S82bD/Y97H |
| H1047 | S30D/D31K/A52cD/R57P/Q81T/S82bD/Y97H |
| H1048 | D31E/A52cD/R57P/Q81T/S82bD/Y97H |
| H1049 | S30D/D31K/A52cD/G54Y/Y55H/R57P/Q81T/S82bD/Y97H |
| H1050 | D31E/A52cD/G54Y/Y55H/R57P/Q81T/S82bD/Y97H |

TABLE 21-3

| L395 | N50K/L54H/Q89K |
|---|---|
| L442 | S31E/N50K/L54H/Q89K |

A total of 36 types of antibodies were produced by combining the 18 types of heavy chains and two types of light chains described above. Various evaluations were performed on these antibodies as indicated below.

The human IL-8-binding affinities under neutral and acidic pH conditions were measured in a manner similar to the method of Example 13-3. Among the obtained results, KD at pH 7.4, and KD and koff at pH 5.8 are shown in Table 22.

Next, stability in terms of IL-8 binding upon storage of the antibodies in PBS was evaluated by the method indicated below.

The respective antibodies were dialyzed overnight against DPBS (Sigma-Aldrich), and then the concentration of each of the antibodies was adjusted to 0.1 mg/mL. At this point, some of the antibody samples were collected as initial samples. The remaining samples were stored at 50° C. for one week, and then collected as samples for the thermal acceleration test.

Next, BIACORE measurement of the IL-8-binding affinity was carried out as follows using the initial samples and samples for the thermal acceleration test.

The levels of human IL-8 binding to the modified antibodies were analyzed using BIACORE T200 (GE Healthcare). Measurements were carried out at 40° C. by using 0.05% tween 20, 40 mM ACES, and 150 mM NaCl at pH 7.4 as the running buffer.

An appropriate amount of Protein A/G (PIERCE) was immobilized onto the Sensor chip CM4 (GE Healthcare) by the amine coupling method and the antibodies of interest was captured. Next, a diluted human IL-8 solution or a running buffer (used as a reference solution) was injected to allow interaction of the antibodies captured onto the sensor chip with human IL-8. The running buffer was also used to dilute human IL-8. To regenerate the sensor chip, 25 mM NaOH and 10 mM glycine-HCl (pH 1.5) were used. The measured binding level of human IL-8 and the amount of antibodies captured at that binding level were extracted using the BIACORE T200 Evaluation Software (GE Healthcare).

The amount of human IL-8-binding per 1000 RU of the amount of antibody captured was calculated for the initial samples and the samples for the thermal acceleration test. Furthermore, the ratio of the human IL-8-binding level for the initial samples to that for samples of the thermal acceleration test was calculated.

The resulting ratios of IL-8-binding level of the initial samples to that for samples of the thermal acceleration test are shown in Table 22 as well.

TABLE 22

| Antibody | pH7.4 KD | pH5.8 KD | pH5.8 koff | Ratio of IL-8 Binding Amount (Thermal Acceleration/Initial) |
|---|---|---|---|---|
| H0089/L0118 | 1.7E−10 | 4.9E−08 | 6.3E−03 | 0.61 |
| H0932/L0395 | 1.6E−10 | 1.1E−07 | 5.7E−02 | 0.56 |
| H0932/L0442 | 2.1E−10 | 7.9E−08 | 2.2E−02 | 0.56 |
| H1000/L0395 | 1.4E−10 | 8.9E−08 | 2.0E−02 | 0.57 |
| H1000/L0442 | 2.0E−10 | 7.1E−08 | 1.7E−02 | 0.57 |
| H1004/L0395 | 1.5E−10 | 1.1E−07 | 3.4E−02 | 0.58 |
| H1004/L0442 | 2.2E−10 | 7.7E−08 | 2.0E−02 | 0.59 |
| H1009/L0395 | 7.1E−11 | 8.7E−08 | 1.0E−02 | 0.64 |
| H1009/L0442 | 1.1E−10 | 6.3E−08 | 6.0E−03 | 0.64 |
| H1022/L0395 | 2.7E−10 | 2.9E−07 | 1.2E+01 | 0.47 |
| H1022/L0442 | 3.6E−10 | 1.8E−07 | 2.0E−02 | 0.46 |
| H1023/L0395 | 7.6E−11 | 9.2E−08 | 1.8E−02 | 0.54 |
| H1023/L0442 | 1.2E−10 | 7.1E−08 | 1.7E−02 | 0.55 |
| H1028/L0395 | 1.8E−10 | 2.1E−07 | 1.0E+01 | 0.55 |
| H1028/L0442 | 2.4E−10 | 1.4E−07 | 1.3E−01 | 0.56 |
| H1029/L0395 | 8.6E−11 | 5.5E−08 | 8.0E−03 | 0.59 |
| H1029/L0442 | 1.4E−10 | 4.8E−08 | 8.5E−03 | 0.58 |
| H1031/L0395 | 1.5E−10 | 9.9E−08 | 4.6E−02 | 0.48 |
| H1031/L0442 | 2.1E−10 | 8.9E−08 | 3.9E−02 | 0.47 |
| H1032/L0395 | 4.2E−11 | 5.0E−08 | 4.1E−03 | 0.61 |
| H1032/L0442 | 7.8E−11 | 4.3E−08 | 5.9E−03 | 0.61 |
| H1037/L0395 | 9.4E−11 | 7.0E−08 | 1.5E−02 | 0.55 |
| H1037/L0442 | 1.3E−10 | 6.1E−08 | 1.5E−02 | 0.57 |
| H1040/L0395 | 2.6E−10 | 2.4E−07 | 4.6E−02 | 0.44 |
| H1040/L0442 | 3.4E−10 | 1.4E−07 | 2.1E+01 | 0.49 |
| H1041/L0395 | 8.0E−11 | 7.1E−08 | 1.3E−02 | 0.55 |
| H1041/L0442 | 1.2E−10 | 6.1E−08 | 1.5E−02 | 0.56 |
| H1046/L0395 | 1.8E−10 | 1.6E−07 | 1.2E−02 | 0.56 |
| H1046/L0442 | 2.3E−10 | 1.1E−07 | 1.2E−02 | 0.55 |
| H1047/L0395 | 9.5E−11 | 4.7E−08 | 6.0E−03 | 0.65 |
| H1047/L0442 | 1.5E−10 | 4.7E−08 | 4.6E−03 | 0.64 |

TABLE 22-continued

| Antibody | pH7.4 KD | pH5.8 KD | pH5.8 koff | Ratio of IL-8 Binding Amount (Thermal Acceleration/Initial) |
|---|---|---|---|---|
| H1048/L0395 | 1.5E−10 | 9.0E−08 | 6.4E−03 | 0.59 |
| H1048/L0442 | 2.1E−10 | 6.7E−08 | 1.5E−02 | 0.59 |
| H1049/L0395 | 2.5E−11 | 3.8E−08 | 4.0E−03 | 0.65 |
| H1049/L0442 | 5.3E−11 | 3.3E−08 | 4.5E−03 | 0.65 |
| H1050/L0395 | 6.6E−11 | 7.7E−08 | 5.0E−03 | 0.64 |
| H1050/L0442 | 9.9E−11 | 5.4E−08 | 7.6E−03 | 0.64 |

By the above-mentioned examination, H1009/L395 which is an antibody comprising H1009-IgG1m (SEQ ID NO:92) as the heavy chain and L395-k0MT as the light chain was obtained.

As shown in Table 22, in comparison to H89/L118, H1009/L395 had a slightly enhanced human IL-8-binding affinity at neutral pH, but on the other hand, a decreased binding affinity at acidic pH, that is, pH-dependence had been further strengthened. Furthermore, when exposed to severe conditions such as at 50° C. in PBS, H1009/L395 had a slightly enhanced stability in IL-8 binding when compared to that of H89/L118.

Accordingly, H1009/L395 was selected as an antibody whose neutralizing activity in mouse plasma may be stably maintained, while keeping its pH-dependent IL-8 binding ability.

(14-2) Stability Evaluation of H1009/L395

Next, in a manner similar to the method of Example 12-3, it was evaluated whether the IL-8 neutralizing activity of H1009/L395 is stably maintained in mouse plasma. Here, H1009/L395-F1886s which will be described in detail later in Example 19 was used. This antibody has the same variable region as that of H1009/L395, and a constant region having modifications that enhance FcRn binding under acidic pH conditions and modifications for reducing its binding towards FcγR(s) in comparison to those of the native human IgG1. The variable region of H1009/L395, especially the region around HVR, is responsible for human IL-8-binding and IL-8-neutralizing activity of this antibody, and modifications introduced into the constant region are considered not to affect these properties.

Evaluation of the stability in mouse plasma was performed as follows. 150 μL of 200 mM phosphate buffer (pH 6.7) was added to 585 μL of mouse plasma. Then, sodium azide was added as an antiseptic at a final concentration of 0.1%. Each antibody (Hr9, H89/L118, or H1009/L395-F1886s) was added to the above-mentioned mouse plasma at a final concentration of 0.4 mg/mL. At this point, a portion of the sample was collected as the initial sample. The remaining sample was stored at 40° C. One week and two weeks after the start of storage, a portion of each sample was collected, and they were used as the sample stored for one week and the sample stored for two weeks. All samples were frozen at −80° C. and stored until each analysis was performed.

Measurement of the human IL-8-neutralizing activity was carried out using human CXCR2-expressing cells by a method similar to that of Example 12-3. However, the concentration of human IL-8 used to confirm the neutralizing activity of an anti-human IL-8 antibody this time was 1.2 nM.

The results of human IL-8 inhibition assay obtained using the above-mentioned antibodies with human CXCR2-expressing cells are shown in FIG. 28A, which shows results for the initial sample (without storage treatment in mouse plasma), FIG. 28B, which shows results for the samples stored at 40° C. for one week, and FIG. 28C, which shows results for the samples stored at 40° C. for two weeks.

As a result, surprisingly, the human IL-8-neutralizing activity was maintained in H1009/L395-F1886s even after it was stored in mouse plasma at 40° C. for two weeks, and the IL-8-neutralizing activity was more stably maintained than in the case of H553/L118.

(14-3) Mouse PK Assay Using H1009/L395

The rate of human IL-8 elimination by H1009/H395 in mice was evaluated by the following method. H1009/L395, H553/L118, and H998/L63 were used as the antibodies. Administration to mice and blood collection, and measurement of the human IL-8 concentration in mouse plasma were carried out by the method shown in Example 11.

The resulting data on the concentration of human IL-8 in plasma are shown in FIG. 29, and the values of human IL-8 clearance (CL) from mouse plasma are shown in Table 23.

TABLE 23

| Antibody Name | Human IL-8 CL (mL/d/kg) | | |
|---|---|---|---|
| | H998/L63 | H553/L118 | H1009/1395 |
| #1 | 21.4 | 773.2 | 705.0 |
| #2 | 27.5 | 497.6 | 777.3 |
| #3 | 24.7 | 879.8 | 737.7 |
| Average (N = 3) | 24.5 | 716.9 | 740.0 |
| Standard Deviation | 3.0 | 197.2 | 36.2 |

As a result, the rate of human IL-8 elimination in mice when H1009/L395 was administered at 2 mg/kg was equivalent to that of H553/L118, and it was shown that H1009/L395 achieves nearly 100% free IL-8 in the endosome. The value of clearance (CL) which quantitatively represents the rate of human IL-8 elimination from mouse plasma was shown to be approximately 30-fold higher than that of H998/L63.

Without being particularly limited, the effect of increasing the rate of human IL-8 elimination can be understood as follows. Generally, in a living body where antigens are maintained at nearly constant concentrations, production rates and elimination rates of antigens will also be maintained at nearly constant values. When antibodies are administered under such conditions, even in cases where the antigen production rates are not affected, the rates of antigen elimination may change due to the complex formation of antigen with antibodies. Generally, since the antigen-elimination rate is greater than the antibody-elimination rate, in such cases, the elimination rate of antigens that have formed complexes with antibodies decreases. When the antigen elimination rate decreases, the antigen concentration in plasma increases, but the degree of increase in this case may also be defined by the ratio of the elimination rate when the antigen is present alone to the elimination rate when the antigen forms a complex. That is, in comparison to the elimination rate when the antigen is present alone, if the elimination rate when a complex is formed is decreased to one tenth, the antigen concentration in the plasma of the antibody-administered organism may increase up to approximately ten times that before antibody administration. Here, clearance (CL) may be used as the elimination rate. More specifically, increase of the antigen concentration (antigen accumulation) that takes place after antibody administration to an organism may be defined by the antigen CL under each of the conditions before antibody administration and after antibody administration.

Here, the presence of an approximately 30-fold difference in CL of human IL-8 when H998/L63 and H1009/L395 were administered suggests that there may be an approximately 30-fold difference between the levels of increase in the human IL-8 concentration in plasma when these antibodies are administered to humans. Furthermore, generation of a 30-fold difference in the human IL-8 concentration in plasma indicates that there will also be approximately a 30-fold difference in the amount of antibodies necessary for completely blocking the biological activity of human IL-8 under the respective conditions. That is, in comparison to H998/L63, H1009/L395 can block the biological activity of IL-8 in plasma at approximately 1/30 of the amount, which is a very small amount of antibody. Furthermore, when H1009/L395 and H998/L63 are individually administered to humans at the same dose, H1009/L395 will be able to block the biological activity of IL-8 for a longer period of time with greater strength. To block the biological activity of IL-8 for a long period of time, it is necessary that the IL-8-neutralizing activity is stably maintained. As shown in Example 14, experiments using mouse plasma have elucidated that H1009/L395 can maintain its human IL-8-neutralizing activity for a long period of time. H1009/L395 which has these noteworthy properties was also shown to be an antibody that has superior effects from the viewpoint of the efficacy in neutralizing IL-8 in vivo.

Example 15

Evaluation of Extracellular Matrix-Binding Using the pH-Dependent IL-8-Binding Antibody H1009/L395

The excellent 30-fold greater effect of H1009/L395 in eliminating human IL-8 as shown in Example 14 was a surprising effect. It is known that the rate of antigen elimination when a pH-dependent antigen-binding antibody is administered depends on the rate of uptake of the antibody-antigen complex into cells. That is, if the rate of the pH-dependent antigen-binding antibody uptake into cells increases when an antigen-antibody complex is formed in comparison to when the complex is not formed, the antigen-eliminating effect of the pH-dependent antibody can be increased. Known methods for increasing the rate of uptake of an antibody into cells include the method of conferring the FcRn-binding ability under neutral pH conditions to an antibody (WO 2011/122011), the method for enhancing the binding ability of an antibody towards FcγR(s) (WO 2013/047752), and the method that uses promotion of the formation of complexes containing a polyvalent antibody and a polyvalent antigen (WO 2013/081143).

However, the above-mentioned technique is not used in the constant regions of H1009/L395. Furthermore, while IL-8 is known to form a homodimer, human IL-8 bound by H1009/L395 has been found to exist in the form of a monomer because H1009/L395 recognizes the homodimer-forming surface of human IL-8. Therefore, this antibody will not form polyvalent complexes.

More specifically, while the above-mentioned technique is not used for H1009/L395, H1009/L395 showed a 30-fold greater human IL-8-eliminating effect.

Then, the inventors carried out the following discussion as a possible factor that may bring about the aforementioned properties of pH-dependent IL-8-binding antibodies represented by H1009/L395. However, the following is only a possibility surmised by the inventors based on the technical background, and the content of Disclosure C is not limited to the content of the following discussion.

Human IL-8 is a protein that has a high isoelectric point (pI), and the theoretical isoelectric point calculated by a known method is approximately 10. That is, under neutral pH conditions, human IL-8 is a protein whose charge is shifted towards the positive side. pH-dependent IL-8-binding antibodies represented by H1009/L395 are also proteins whose charge is shifted towards the positive side, and the theoretical isoelectric point of H1009/L395 is approximately 9. That is, the isoelectric point of a complex produced by binding of H1009/L395, a protein that has a high isoelectric point and is originally rich in positive charges, to human IL-8 which has a high isoelectric point will be higher than that of H1009/L395 alone.

As shown in Example 3, increasing the isoelectric point of an antibody, which includes increasing the number of positive charges and/or decreasing the number of negative charges on the antibody, can be considered to increase non-specific uptake of the antibody-antigen complex into cells. The isoelectric point of complex formed between an anti-IL-8 antibody and human IL-8 which has a high isoelectric point is higher compared to that of the anti-IL-8 antibody alone, and the complex may be taken up more readily into cells.

As described earlier, affinity for the extracellular matrix is also a factor that may influence uptake into cells. Then, it was examined whether there is a difference in extracellular matrix binding between an antibody alone and a complex with a human IL-8-antibody.

Evaluation of the Amount of Antibody Binding to the Extracellular Matrix by the ECL (Electroluminescence) Method Extracellular Matrix (the BD Matrigel Basement Membrane Matrix/manufactured by BD) was diluted to 2 mg/mL using TBS (Takara, T903). The diluted extracellular matrix was dispensed into the MULTI-ARRAY 96well Plate, High bind, Bare (manufactured by Meso Scale Discovery: MSD) at 5 μL per well, and immobilized overnight at 4° C. Then, blocking was performed using 20 mM ACES buffer (pH 7.4) containing 150 mM NaCl, 0.05% Tween 20, 0.5% BSA, and 0.01% NaN$_3$.

The antibodies to be evaluated were prepared as follows. The antibody samples to be added alone were prepared by diluting each antibody to 9 μg/mL using Buffer 1 (20 mM ACES buffer containing 150 mM NaCl, 0.05% Tween 20, and 0.01% NaN$_3$, at pH 7.4), and then further diluting them using Buffer2 (20 mM ACES buffer containing 150 mM NaCl, 0.05% Tween 20, 0.1% BSA, and 0.01% NaN$_3$, at pH 7.4) to a final concentration of 3 μg/mL.

On the other hand, the antibody samples to be added as a complex with human IL-8 were prepared by adding human IL-8 at ten times the molar concentration of the antibody to an antibody sample, then diluting each antibody using Buffer-1 so that the antibody concentration became 9 μg/mL, respectively, and then further diluting each of them using Buffer-2 to a final antibody concentration of 3 μg/mL. At this point, the human IL-8 concentration was approximately 0.6 μg/mL. This was shaken at room temperature for one hour for complex formation.

Next, solutions of the antibody alone or the antibody as a complex were added to the plate from which the blocking solution had been removed, and this was shaken at room temperature for one hour. Then, after removal of the antibody-alone solution or the complex solution, Buffer-1 containing 0.25% Glutaraldehyde was added. Then, after the plate was allowed to stand for 10 minutes, it was washed with DPBS (manufactured by Wako Pure Chemical Industries) containing 0.05% Tween 20. An antibody for ECL detection was prepared by sulfo-tagging the goat anti-human IgG (gamma) (manufactured by Zymed Laboratories) using the Sulfo-Tag NHS Ester (manufactured by MSD). The antibody for ECL detection was diluted with Buffer-2 to be 1 μg/mL, added to the plate, and then shaken in the dark at room temperature for one hour. The antibody for ECL detection was removed, a solution produced by 2-fold dilution of the MSD Read Buffer T (4×) (manufactured by MSD) using ultrapure water was added, and then the amount of luminescence was measured by SECTOR Imager 2400 (manufactured by MSD).

The results are shown in FIG. 30. Interestingly, all of the anti-IL-8 antibodies such as H1009/L395 hardly showed any binding to the extracellular matrix as the antibody alone (-IL8), but bound to the extracellular matrix upon complex formation with human IL-8 (+hIL8).

As described above, the property of anti-IL-8 antibodies to acquire affinity for the extracellular matrix by binding to human IL-8 has not been elucidated. Furthermore, without being limited, combining such properties with pH-dependent IL-8-binding antibodies can increase the rate of IL-8 elimination more efficiently.

Example 16

Mouse PK Assay Using Non-FcRn-Binding Antibodies

The following method was used to confirm whether a complex between human IL-8 and a pH-dependent IL-8-binding antibody is formed and uptake of that complex into cells increases in mice.

First, an antibody variant comprising the variable region of H1009/L395 and an Fc region deficient in binding affinity to various Fc receptors was produced. Specifically, as modifications for deleting the binding ability towards human FcRn under acidic pH conditions, the heavy chain H1009-IgG1 was subjected to substitution of alanine for isoleucine at position 253 and aspartic acid for serine at position 254, according to EU numbering. Furthermore, as modifications for deleting the binding to mouse FcγR(s), leucine at position 235 was substituted with arginine, glycine at position 236 was substituted with arginine, and serine at position 239 was substituted with lysine. 1009-F1942m (SEQ ID NO:93) was produced as a heavy chain containing four of these modifications. Furthermore, H1009/L395-F1942m comprising H1009-F1942m as the heavy chain and L395-k0MT as the light chain was produced.

Since antibody that has this Fc region is deficient in the FcRn binding affinity under acidic pH conditions, it is not transferred from the endosome into plasma. Therefore, such antibody is quickly eliminated from plasma in a living body as compared to antibody that comprises native Fc region. In this case, after the antibody that comprises native Fc region is incorporated into cells, only a portion of them that is not salvaged by FcRn is degraded after being transferred to the lysosome, but in the case of antibody comprising Fc region that does not comprise FcRn-binding affinity, all of the antibody incorporated into the cells are degraded in lysosomes. More specifically, in the case of antibody that comprise such modified Fc region, the rate of elimination of the administered antibody from plasma may be equivalent to the rate of incorporation into cells. That is, the rate of intracellular uptake of the antibody whose FcRn-binding affinity has been deleted can also be confirmed by measuring the rate of elimination of these antibodies from plasma.

Then, whether intracellular uptake of the complex formed between H1009/L395-F1942m and human IL-8 increases as compared to the uptake of H1009/L395-F1942m alone was tested. Specifically, whether the rate of elimination of the antibody from plasma will change when the antibody is administered alone and when the antibody is administered upon formation of a complex with human IL-8 was tested.

The respective biokinetics of the anti-human IL-8 antibody was evaluated in cases when the anti-human IL-8 antibody was administered alone to human FcRn transgenic mice (B6.mFcRn−/−.hFcRn Tg line 32+/+ mouse; Jackson Laboratories; Methods Mol. Biol. 602:93-104 (2010)) and when human IL-8 and the anti-human IL-8 antibody were administered simultaneously to the human FcRn transgenic mice. The anti-human IL-8 antibody solution (200 μg/mL), and a mixed solution of human IL-8 (10 μg/mL) and the anti-human IL-8 antibody (200 μg/mL) were individually administered once at 10 mL/kg to the tail vein. In this case, since the anti-human IL-8 antibody was present in sufficient excess over human IL-8, almost all of human IL-8 was considered to be bound to the antibody. Blood was collected five minutes, two hours, seven hours, one day, and two days after the administration. The collected blood was immediately centrifuged at 4° C. and 15,000 rpm for 15 minutes to obtain plasma. The separated plasma was stored in a freezer set to −20° C. or below until measurements were taken.

The anti-human IL-8 antibody concentration in mouse plasma was measured by an electrochemiluminescence method. First, to the Streptavidin Gold Multi-ARRAY Plate (Meso Scale Discovery) which had been blocked overnight at room temperature using a PBS-Tween solution containing 5% BSA (w/v), an Anti-Human Kappa Light Chain Goat IgG Biotin (IBL) was allowed to react at room temperature for one hour to produce an anti-human antibody-immobilized plate. Samples for calibration curve containing the anti-human IL-8 antibody at concentrations of 3.20, 1.60, 0.800, 0.400, 0.200, 0.100, and 0.0500 μg/mL in plasma and samples for mouse plasma measurement diluted 100-fold or higher were prepared. Each sample was mixed with human IL-8, and then dispensed at 50 μL per well into the anti-human antibody-immobilized plate, and then stirred at room temperature for one hour. Human IL-8 was adjusted to a final concentration of 333 ng/mL.

Then, an anti-human IL-8 antibody (prepared in-house) comprising a mouse IgG constant region was added to the plate, and was allowed to react at room temperature for one hour. Furthermore, the Anti-Mouse IgG (BECKMAN COULTER) ruthenium-labeled with the SULFO-TAG NHS Ester (Meso Scale Discovery) was added to the plate, and this was allowed to react for one hour. Then, immediately after the Read Buffer T(×1) (Meso Scale Discovery) was dispensed into the plate, measurement was carried out using SECTOR Imager 2400 (Meso Scale Discovery). The anti-human IL-8 antibody concentration was calculated based on the response in the calibration curve using the analytical software, the SOFTmax PRO (Molecular Devices).

Antibody concentrations in mouse plasma obtained as a result are shown in FIG. 31, and the antibody clearance under the respective conditions are shown in Table 24.

TABLE 24

| Antibody Name | IL8 µg/kg | CL mL/d/kg |
|---|---|---|
| H1009/L395-F1942m | — | 134 |
| H1009/L395-F1942m | 100 | 291 |

The rate of intracellular uptake of the complex of H1009/L395-F1942m and human IL-8 was shown to be increased by at least 2.2 fold compared to the uptake rate of H1009/L395-F1942m. Here, it is noted as "at least 2.2-fold" because of the following reason which is included as one of the possibilities that the value may actually be 5-fold, 10-fold, or 30-fold. As the rate of elimination of human IL-8 from mouse plasma is very rapid compared to the rate of elimination of H1009/L395-F1942m, the proportion of H1009/L395-F1942m bound by human IL-8 in plasma quickly decreases after administration. More specifically, even when administered simultaneously with human IL-8, not all H1009/L395-F1942m present in the plasma are in the human IL-8-bound form, and in fact, at approximately seven hours after administration, most of them already exist in the free form. Since the uptake rate is evaluated under such conditions, even if the rate of intracellular uptake of the complex of H1009/L395-F1942m and human IL-8 has been actually increased five-fold, ten-fold, or 30-fold in comparison to the uptake rate of H1009/L395-F1942m, the results in this experiment system are reflected only partially; therefore, the effect may possibly be presented as an increase of 2.2-fold or so. Accordingly, from these obtained results, whereas the intracellular uptake rate of the complex of H1009/L395 and IL-8 was shown to be increased compared to the actual intracellular uptake rate of H1009/L395 in vivo, this effect is not limited to the obtained value of 2.2-fold increase.

2.2-fold or greater compared to the uptake rate of H1009/L395. From the above, the theoretical explanation as well as the in vitro properties and in vivo phenomena consistently support the hypothesis that H1009/L395 and human IL-8 form a complex to promote uptake of the complex into cells, and leads to a remarkable increase in the elimination of human IL-8.

Several antibodies against IL-8 have been reported to date, but there has been no report so far on the increase of binding affinity to the extracellular matrix upon complex formation with IL-8 and the increase in uptake of the complexes into cells.

Furthermore, based on the finding that an increase in the intracellular uptake of the anti-IL-8 antibodies is observed when the antibodies form complexes with IL-8, one may consider that the anti-IL-8 antibodies that have formed complexes with IL-8 in plasma are quickly taken up into cells, while the free antibodies which have not formed complexes with IL-8 tend to be retained in plasma without being taken up into cells. In this case, when the anti-IL-8 antibody is pH-dependent, the anti-IL-8 antibody which has been taken up into the cells releases the IL-8 molecule in the cells and then returns to the outside of the cells, and then it can bind to another IL-8 molecule; and therefore, increase in the intracellular uptake upon complex formation may have a further effect of eliminating IL-8 more strongly. That is, selecting anti-IL-8 antibodies with increased binding to the extracellular matrix or anti-IL-8 antibodies with increased uptake into cells may also be another embodiment of Disclosure C.

Example 17

Immunogenicity Prediction of the pH-Dependent IL-8-Binding Antibody H1009/L395 Using an in Silico System Next, the immunogenicity score and frequency of ADA development were predicted for H1009/L395 by a method similar to that of Example 13-1. The results are shown in Table 25 and FIG. 32. In FIG. 32, H1009/L395 is noted as "H1009L395".

TABLE 25

| | Heavy Chain | | Light Chain | | Total | |
|---|---|---|---|---|---|---|
| Antibody Name | EpiMatrix Score | tReg Adjusted Epx Score | EpiMatrix Score | tReg Adjusted Epx Score | EpiMatrix Score | tReg Adjusted Epx Score |
| hWS-4 | 62.44 | 12.18 | 22.64 | −23.89 | 85.08 | −11.71 |
| H1004/L395 | 10.79 | −39.47 | 7.79 | −38.74 | 18.58 | −78.21 |
| H1009/L395 | 9.62 | −40.64 | 7.79 | −38.74 | 17.41 | −79.38 |

Without being particularly limited, the following interpretation may be made from the findings obtained so far. When H1009/L395, which is a pH-dependent IL-8-binding antibody, forms a complex with human IL-8, that complex has a higher isoelectric point and is shifted more towards a positive charge than when the antibody alone exists. At the same time, the affinity of the complex towards the extracellular matrix is more increased than the affinity of the antibody alone. Properties such as elevation of isoelectric point and enhancement of the extracellular matrix binding can be considered as factors that promote uptake of an antibody into cells in vivo. Furthermore, from mouse experiments, the rate of intracellular uptake of the complex of H1009/L395 and human IL-8 was shown to be increased The results in Table 25 show that H1009/L395 has the same level of low immunogenicity scores as H1004L395. Furthermore, the frequency of ADA development predicted for H1009/L395 from the results in FIG. 32 was 0%, and this was also similar to that of H1004/L395.

Accordingly, the predicted immunogenicity was greatly decreased for H1009/L395 in comparison to the known anti-human IL-8 antibody hWS-4. Therefore, H1009/L395 is considered to have very low immunogenicity in humans, and to be able to stably maintain the anti-IL-8-neutralizing activity for a long period of time.

Example 18

Cynomolgus Monkey PK Assay Using an H89/L118 Variant with Enhanced FcRn-Binding Ability Under Acidic pH Conditions As described in the Examples above, among the cases where the antibodies have native IgG1 as their constant region, the pH-dependent IL-8-binding antibody H1009/L395 is an antibody that has superior properties. However, such antibodies can also be used as antibodies containing amino acid substitutions in the constant region, for example, those containing an Fc region with enhanced FcRn binding at acidic pH, as exemplified in Example 5. Therefore, H89/L118 was used to confirm that the Fc region with enhanced FcRn binding at acidic pH can also function in a pH-dependent IL-8-binding antibody.

(18-1) Production of an H89/L118 Fc Region-Modified Antibody with Enhanced FcRn Binding at Acidic pH Various modifications for enhancing FcRn binding as described in Example 5-1 were introduced into the Fc region of H89/L118. Specifically, the following variants were produced by introducing the modifications used in F1847m, F1848m, F1886m, F1889m, F1927m, and F1168m into the Fc region of H89-IgG1: (a) H89/L118-IgG1 comprising H89-IgG1m (SEQ ID NO:94) as the heavy chain and L118-K0MT as the light chain; (b) H89/L118-F1168m comprising H89-F1168m (SEQ ID NO:95) as the heavy chain and L118-K0MT as the light chain; (c) H89/L118-F1847m comprising H89-F1847m (SEQ ID NO:96) as the heavy chain and L118-K0MT as the light chain; (d) H89/L118-F1848m comprising H89-F1848m (SEQ ID NO:97) as the heavy chain and L118-K0MT as the light chain; (e) H89/L118-F1886m comprising H89-F1886m (SEQ ID NO:98) as the heavy chain and L118-K0MT as the light chain; (f) H89/L118-F1889m comprising H89-F1889m (SEQ ID NO:99) as the heavy chain and L118-K0MT as the light chain; and (g) H89/L118-F1927m comprising H89-F1927m (SEQ ID NO:100) as the heavy chain and L118-K0MT as the light chain. Cynomolgus monkey PK assays using these antibodies were carried out by the method shown below.

(18-2) Cynomolgus Monkey PK Assay of Novel Fc Region Variant-Containing Antibodies After administration of anti-human IL-8 antibodies to cynomolgus monkeys, biokinetics of the anti-human IL-8 antibodies was evaluated. An anti-human IL-8 antibody solution was intravenously administered once at 2 mg/kg. Blood was collected five minutes, four hours, one day, two days, three days, seven days, ten days, 14 days, 21 days, 28 days, 35 days, 42 days, 49 days, and 56 days after administration. The collected blood was immediately centrifuged at 4° C. and 15,000 rpm for ten minutes to obtain plasma. The separated plasma was stored in a freezer set to −60° C. or below until measurements were taken.

The anti-human IL-8 antibody concentration in cynomolgus monkey plasma was measured by an electrochemiluminescence method. First, the Anti-hKappa Capture Ab (Antibody Solutions) was dispensed into a MULTI-ARRAY 96-well Plate (Meso Scale Discovery), and was stirred at room temperature for one hour. Then, a PBS-Tween solution containing 5% BSA (w/v) was used for blocking at room temperature for two hours to prepare an anti-human antibody-immobilized plate. Samples for calibration curve containing an anti-human IL-8 antibody at concentrations of 40.0, 13.3, 4.44, 1.48, 0.494, 0.165, and 0.0549 μg/mL in plasma and samples for cynomolgus monkey plasma measurement diluted 500-fold or more were prepared, 50 μL of the solutions were dispensed into each well of the anti-human antibody-immobilized plate, and the solutions were stirred at room temperature for one hour. Then, the Anti-hKappa Reporter Ab, Biotin conjugate (Antibody Solutions) was added to the aforementioned plate, and allowed to react at room temperature for one hour. After further adding the SULFO-TAG Labeled Streptavidin (Meso Scale Discovery) and allowing to react at room temperature for one hour, the Read Buffer T(×1) (Meso Scale Discovery) was dispensed into the plate, and measurements were taken immediately using SECTOR Imager 2400 (Meso Scale Discovery). The anti-human IL-8 antibody concentration was calculated based on the response in the calibration curve using the analytical software, the SOFTmax PRO (Molecular Devices).

The results obtained for the half-life (t1/2) and clearance (CL) of each of the antibodies are shown in Table 26, and changes in the antibody concentration in cynomolgus monkey plasma are shown in FIG. 33.

TABLE 26

| Antibody Name | $t^{1/2}$ day | CL mL/d/kg |
|---|---|---|
| H89/L118-IgG1 | 11.9 | 2.95 |
| H89/L118-F1168m | 24.1 | 3.21 |
| H89/L118-F1847m | 27.9 | 2.09 |
| H88/L118-F1848m | 25.3 | 1.74 |
| H89/L118-F1886m | 45.1 | 1.34 |
| H89/L118-F1889m | 39.5 | 1.75 |
| H89/L118-F1927m | 30.3 | 2.13 |

The above results confirmed that all of the Fc region variants show prolonged retention in plasma in comparison to the antibody that has a native IgG1 Fc region. In particular, H89/L118-F1886m showed the most desirable blood kinetics.

Example 19

Fc Region with Lowered Binding Ability Towards FcγRs

The Fc region of a native human IgG1 is known to bind to Fcγreceptor(s) (hereinafter, referred to as FcγR(s)) on various cells of the immune system, and exhibit effector functions such as ADCC and ADCP on target cells.

On the other hand, IL-8 is a soluble cytokine, and anti-IL-8 antibodies used as pharmaceuticals are mainly expected to show pharmacological actions by neutralizing the functions of IL-8 at sites where IL-8 is present in excess. Such sites where IL-8 is present in excess are not particularly limited, and for example, may be inflamed sites. It is known that generally at such inflamed sites, various immune cells gather and are activated. Transmitting unintended activation signals to these cells via Fc receptors and inducing activities such as ADCC and ADCP in unintended cells are not always favorable. Therefore, without being particularly limited, from a safety point of view, it may be preferable that anti-IL-8 antibodies administered in vivo have low affinity towards FcγRs.

(19-1) Production of Modified Antibodies with Lowered Binding Towards FcγRs

Amino acid modifications were further introduced into the Fc region of H1009/L395-F1886m with the objective of reducing the binding ability towards various human and cynomolgus monkey FcγRs. Specifically, H1009-F1886s (SEQ ID NO:81) was produced by subjecting the H1009-F1886m heavy chain to each of the following substitutions: R for L at position 235, R for G at position 236, and K for S at position 239, according to EU numbering. Similarly, H1009-F1974m (SEQ ID NO:80) was produced by subjecting H1009-F1886m to substitution of R for L at position 235 and R for G at position 236, according to EU numbering, and substituting the region from position 327 to position 331 according to EU numbering with that of the native human IgG4 sequence. H1009/L395-F1886s and H1009/L395-F1974m were produced as antibodies having these heavy chains, and L395-k0MT as the light chain.

(19-2) Confirmation of the Affinity Towards Various Human FcγRs

Next, the affinities of the H1009/L395-F1886s or H1009/L395-F1974m towards the soluble forms of FcγRIa or FcγRIIIa in human or cynomolgus monkey were confirmed by the following method.

Assays were performed for the binding of the H1009/L395-F1886s or the H1009/L395-F1974m to the soluble forms of FcγRIa or FcγRIIIa in human or cynomolgus monkey using BIACORE T200 (GE Healthcare). Soluble FcγRIa and FcγRIIIa in both human and cynomolgus monkey were produced in the form of His-tagged molecules by methods known to those of ordinary skill in the art. An appropriate amount of rProtein L (BioVision) was immobilized onto the Sensor chip CM4 (GE Healthcare) by the amine coupling method and antibody of interest was captured. Next, soluble FcγRIa or FcγRIIIa was injected with a running buffer (used as a reference solution), and was made to interact with the antibodies captured onto the sensor chip. HBS-EP+ (GE Healthcare) was used as the running buffer, and HBS-EP+ was also used to dilute the soluble FcγRIa or FcγRIIIa. To regenerate the sensor chip, 10 mM glycine-HCl at pH 1.5 was used. All measurements were carried out at 20° C.

The results are shown in FIG. 34. Here, the notations used for human FcγRIa, human FcγRIIIa, cynomolgus monkey FcγRIa, and cynomolgus monkey FcγRIIIa are in the same order: hFcγRIa, hFcγRIIIa, cynoFcγRIa, and cynoFcγRIIIa, respectively. H1009/L395-F1886m was shown to bind to all FcγRs, but on the other hand, the H1009/L395-F1886s and H1009/L395-F1974m were confirmed not to bind to any of the FcγRs.

(19-3) Mouse IL-8 Elimination Assay of Fc Variants

Next, for the H1009/L395-F1886s and H1009/L395-F1974m, the rate of human IL-8 elimination and the retention in plasma of the antibodies in mice were confirmed by the following experiment. Here, three doses of H1009/L395-F1886s, 2 mg/kg, 5 mg/kg, and 10 mg/kg, were used for the evaluation so that the effects of increasing the antibody dosage can also be evaluated for H1009/L395-F1886s.

After simultaneous administration of human IL-8 and an anti-human IL-8 antibody to human FcRn transgenic mice (B6.mFcRn−/−.hFcRn Tg line 32+/+ mouse; Jackson Laboratories; Methods Mol. Biol. 602:93-104 (2010)), the biokinetics of human IL-8 was evaluated. A mixed solution of human IL-8 (10 μg/mL) and an anti-human IL-8 antibody (200 μg/mL, 500 μg/mL, or 1000 μg/mL) was administered once at 10 mL/kg through the tail vein. In this case, since the anti-human IL-8 antibody was present in sufficient excess over human IL-8, almost all of human IL-8 was considered to be bound to the antibody. Blood was collected five minutes, two hours, four hours, seven hours, one day, two days, three days, seven days, 14 days, 21 days, and 28 days after the administration. The collected blood was immediately centrifuged at 4° C. and 15,000 rpm for 15 minutes to obtain plasma. The separated plasma was stored in a freezer set to −20° C. or below until measurements were taken.

The human IL-8 concentration in mouse plasma was measured by a method similar to that of Example 11. The resulting data on the human IL-8 concentration in plasma is shown in FIG. 35, and the values of human IL-8 clearance (CL) from mouse plasma are shown in Table 27.

First, H1009/L395 comprising the Fc region of a native IgG1 and H1009/L395-F1886s comprising the modified Fc region were shown to have equivalent human IL-8-eliminating effects when the 2 mg/kg-administered groups were compared.

Next, when the dosage of the H1009/L395-F1886s antibody was changed, significant difference in the human IL-8 clearance values was not observed between the 2 mg/kg and 10 mg/kg doses while there was a slight difference in the plasma IL-8 concentration one day after administration. This strongly suggests that antibodies comprising the variable region of H1009/L395 showed sufficient IL-8-eliminating effects even when the antibodies were administered at high doses.

TABLE 27

| Antibody Name | Dose | Human IL-8 CL (mL/d/kg) |
|---|---|---|
| H1009/L395 | 2 mg/kg | 740 |
| H1009/L395-F1886s | 2 mg/kg | 628 |
| H1009/L395-F1886s | 5 mg/kg | 458 |
| H1009/L395-F1886s | 10 mg/kg | 560 |

(19-4) Cynomolgus Monkey PK Assay of Fc Variants

Next, plasma retention of antibodies in cynomolgus monkeys was verified by the following method using H1009/L395-F1886s or H1009/L395-F1974m.

Biokinetics of an anti-human IL-8 antibody were evaluated in case that the anti-human IL-8 antibody was administered alone or in case that human IL-8 and the anti-human IL-8 antibody were simultaneously administered to cynomolgus monkeys. An anti-human IL-8 antibody solution (2 mg/mL) or a mixed solution of human IL-8 (100 μg/kg) and an anti-human IL-8 antibody (2 mg/kg) was intravenously administered once at 1 mL/kg. Blood was collected five minutes, four hours, one day, two days, three days, seven days, ten days, 14 days, 21 days, 28 days, 35 days, 42 days, 49 days, and 56 days after administration. The collected blood was immediately centrifuged at 4° C. and 15,000 rpm for ten minutes to obtain plasma. The separated plasma was stored in a freezer set to −60° C. or below until measurements were taken.

The anti-human IL-8 antibody concentration in cynomolgus monkey plasma was measured by the method of Example 18. The resulting data on the anti-human IL-8 antibody concentration in plasma is shown in FIG. 36, and the values for the half-life ($t_{1/2}$) and clearance (CL) of the anti-human IL-8 antibody from cynomolgus monkey plasma are shown in Table 28.

First, in comparison to Hr9 and H89/L118 which have the Fc region of a native human IgG1, H1009/L395-F1886s which has an Fc region with improved functions was shown to have significantly prolonged plasma retention.

Furthermore, when H1009/L395-F1886s was administered simultaneously with human IL-8, the change in plasma concentration was equivalent to that when the antibody was administered alone. Without being particularly limited, the following discussion is possible from this finding. As described above, intracellular uptake of the complex of H1009/L395 and human IL-8 has been shown to be increased compared to the uptake of H1009/L395 alone. Generally, high-molecular-weight proteins are thought to be incorporated non-specifically or in a receptor-dependent manner into cells, then transferred to the lysosome and degraded by various degrading enzymes present in the lysosome. Therefore, if the rate of uptake of the protein into cells increases, the plasma retention of that protein is likely to worsen as well. However, in the case of an antibody, it has the property of being returned to the plasma by FcRn in the endosome; and therefore, as long as the salvaging by FcRn functions sufficiently, plasma retention may not be affected even if the rate of intracellular uptake is accelerated. Here, even when H1009/L395-F1886s was administered simultaneously with human IL-8 to cynomolgus monkeys, plasma retention was not affected. This indicates the possibility that while the rate of antibody uptake into cells is increased for H1009/L395-F1886s, the antibody is sufficiently salvaged by FcRn such that it can return to the plasma.

Furthermore, another Fc variant H1009/L395-F1974m also showed equivalent plasma retention to that of H1009/L395-F1886s. While these Fc variants have been introduced with different modifications that decrease the binding ability to various FcγRs as describe above, they have been shown not to affect the plasma retention of the antibodies themselves. From the above, plasma retention of both H1009/L395-F1886s and H1009/L395-F1974m in cynomolgus monkeys was shown to be remarkably prolonged and extremely satisfactory in comparison to that of antibodies that have the native IgG1 Fc region.

TABLE 28

| | t½ day | CL mL/d/kg |
|---|---|---|
| Hr9 | 20.26 | 3.72 |
| H89/L118 | 11.88 | 2.95 |
| H1009/L395-F1886s | 35.75 | 1.64 |
| H1009/L395-F1886s + hIL-8 | 72.24 | 1.11 |
| H1009/L395-F1974m + hIL-8 | 43.78 | 1.60 |

As demonstrated in the above-mentioned Examples, by comprising pH-dependent IL-8 binding ability with a feature of being quickly taken up into cells as a complex with IL-8, H1009/L395 achieved for the first time as an antibody that increases significantly the rate of human IL-8 elimination in vivo. Furthermore, the IL-8-binding affinity of this antibody under neutral pH conditions is also increased compared to the known hWS-4 antibody, and the antibody can neutralize human IL-8 more strongly under neutral pH conditions such as in plasma. In addition, it is an antibody that has excellent stability under plasma conditions, and whose IL-8 neutralizing activity does not decrease after it is administered in vivo. Furthermore, H1009/L395, constructed based on Hr9 which has a greatly improved production level as compared to the hWS-4, is an antibody suitable for manufacturing from the viewpoint of production level. Moreover, in in silico immunogenicity prediction, the antibody showed a very low score for its immunogenicity, and this score was significantly lower in comparison to those of the known hWS-4 antibody and several other known commercially available antibodies. That is, it is expected that H1009/L395 would hardly generate ADA in humans, and would be able to be used safely for a long period of time. Accordingly, in comparison to known anti-human IL-8 antibodies, H1009/L395 shows improvement in various aspects, and is very useful as a pharmaceutical.

H1009/L395 which has the native IgG Fc region is sufficiently useful as described above; however, variants of H1009/L395 comprising the functionally-improved Fc region can also be used appropriately as antibodies with enhanced utility. Specifically, it is possible to increase the FcRn binding under acidic pH conditions to prolong plasma retention and to maintain effects for a longer period of time. Furthermore, variants comprising the Fc region introduced with modification(s) that decrease the binding ability to FcγR(s) can be used as high-safety therapeutic antibodies to avoid unintended activation of immune cells and generation of cytotoxic activity in the administered organism. As such Fc variants, the use of F1886s or F1974m exploited herein is particularly favorable, but it is not limited to these Fc variants; and as long as the Fc variant has similar functions, therapeutic antibodies comprising other modified Fc regions are used as an embodiment of Disclosure C.

As a result, the antibodies of Disclosure C including H1009/L395-F1886s and H1009/L395-F1974m generated by the inventors through dedicated research can maintain a condition where the biological activity of human IL-8 is strongly inhibited both safely and for a long period of time. Here, levels that could not be achieved by known anti-IL-8 antibodies have been realized, and these antibodies of Disclosure C are expected to be used as high-quality finished anti-IL-8 antibody pharmaceuticals.

Example 20

Anti-Factor IXa/Factor X Bispecific Antibodies

The humanized anti-factor IXa/factor X bispecific antibodies disclosed in WO2012/067176 bind to human factor IXa and factor X and induce co-aggregation activity of blood. A humanized anti-factor IXa/factor X bispecific antibody F8M(Q499-z121/J327-z119/L404-k:H chain (SEQ ID NO:330)/H chain (SEQ ID NO:331)/common L chain (SEQ ID NO:332)) described in WO2012/067176 was utilized in this example and F8M comprises two different H chains and two same common L chains. F8M was produced by the method described in Examples of WO2012/067176.

(20-1) Production of Anti-Factor IXa/Factor X Bispecific Antibodies

The following three antibodies were produced by the method of Reference Example 2 as anti-factor IXa/factor X bispecific antibodies based on F8M: (a) F8M-F1847mv, which is a conventional antibody comprising F8M-F1847mv1 (SEQ ID NO:323) and F8M-F1847mv2 (SEQ ID NO:324) as the heavy chains and F8ML (SEQ ID NO:325) as the light chain; (b) F8M-F1868mv, which is a conventional antibody comprising F8M-F1868mv1 (SEQ ID NO:326) and F8M-F1868mv2 (SEQ ID NO:327) as the heavy chains and F8ML (SEQ ID NO:325) as the light chain; and (c) F8M-F1927mv, which is a conventional antibody comprising F8M-F1927mv1 (SEQ ID NO:328) and F8M-F1927mv2 (SEQ ID NO:329) as the heavy chains and F8ML (SEQ ID NO:325) as the light chain.

The heavy chain sequences include the same Fc variant sequences regarding the enhancement of FcRn binding and the reduction of the rheumatoid factor binding mentioned in Example 5 as follows:

TABLE 29

| Sequence Name | Name in Example 5 |
|---|---|
| F8M-F1847mv1 (SEQ ID NO: 323) | F1847m |
| F8M-F1847mv2 (SEQ ID NO: 324) | F1847m |

TABLE 29-continued

| Sequence Name | Name in Example 5 |
|---|---|
| F8M-F1868mv1 (SEQ ID NO: 326) | F1868m |
| F8M-F1868mv2 (SEQ ID NO: 327) | F1868m |
| F8M-F1927mv1 (SEQ ID NO: 328) | F1927m |
| F8M-F1927mv2 (SEQ ID NO: 329) | F1927m |

(20-2) Pharmacokinetic Study of Monoclonal Antibodies, F8M-F1847mv, F8M-F1868mv, and F8M-F1927mv, in Cynomolgus Monkey Pharmacokinetics of monoclonal antibodies, F8M-F1847mv, F8M-F1868mv, and F8M-F1927mv, after single bolus intravenous administration at the dose of 0.6 mg/kg to male cynomolgus monkey were each evaluated. The plasma concentrations of F8M-F1847mv, F8M-F1868mv, and F8M-F1927mv were determined by a sandwich ELISA. The pharmacokinetic parameters were calculated using WinNonlin ver 6.4 software. As shown in Table 30, the half-lives of F8M-F1847mv, F8M-F1868mv, and F8M-F1927mv were 29.3 day, 54.5 day, and 35.0 day, respectively. The PK study of F8M using cynomolgus monkey was conducted in a different day at the dose of 6 mg/kg, and the half-life was revealed to be 19.4 day. It was clarified that the half-lives of F8M-F1847mv, F8M-F1868mv, and F8M-F1927mv were longer than F8M. This suggests that the half-life of an anti-factor IXa/X bispecific antibody could be prolonged by the same modification on the Fc region sequence with that mentioned in Example 5 above.

TABLE 30

Half-lives of F8M-F1847mv, F8M-F1868mv, and F8M-F1927mv and F8M after intravenous administration to male cynomolgus monkey

| | F8M-F1847mv | F8M-F1868mv | F8M-F1927mv | F8M |
|---|---|---|---|---|
| Half-life (day) | 29.3 | 54.5 | 35.0 | 19.4 |

Example 21

Evaluation of Clearance of IgE from Plasma Using pI-Increased Fab Variants

To enhance the clearance of human IgE, pI increased substitutions in the Fab portion of antibodies were evaluated in this example using pH-dependent antigen-binding antibodies. The method of adding amino acid substitutions to the antibody variable region to increase pI is not particularly limited, but for example, it can be performed by the method described in WO2007/114319 or WO2009/041643. Amino acid substitutions introduced into the variable region are preferably those that decrease the number of negatively charged amino acids (such as aspartic acid and glutamic acid) while increasing the positively charged amino acids (such as arginine and lysine). Furthermore, amino acid substitutions may be introduced at any position in the antibody variable region. Without particular limitation, the sites for introducing amino acid substitutions are preferably positions where amino acid side chains may be exposed on the antibody molecule surface.

(21-1) Production of Antibodies with Increased pI by Modification of Amino Acids in the Variable Region The tested antibodies are summarized in Table 32 and Table 33.

The heavy chain, Ab1H003 (also called H003, SEQ ID NO:144) was prepared by introducing pI-increasing substitution H32R into Ab1H (SEQ ID NO:38). Other heavy chain variants were also prepared by introducing respective substitutions represented in Table 32 into Ab1H according to the method shown in Reference Example 1. All the heavy chain variants were expressed with Ab1L (SEQ ID NO:39) as light chain. The pH-dependent binding profile of this antibody is summarized in Table 5 (Ab1).

Similarly, we also evaluated the pI-increasing substitution in light chain.

The light chain, Ab1L001T (also called L001, SEQ ID NO:164) was prepared by introducing pI-increasing substitution G16K into Ab1L. Other light chain variants were also prepared by introducing respective substitutions represented in Table 33 into Ab1L according to the method shown in Reference Example 1. All the light chain variants were expressed with Ab1H as heavy chain.

TABLE 32

Heavy Chain Variants of Ab1H evaluated in this Example

| Sample Name (H Chain/ L Chain) | Variant | | Imaging fold | BIACORE fold |
|---|---|---|---|---|
| Ab1H/Ab1L | Original Ab1 | | 1.00 | 1.00 |
| Ab1H003/Ab1L | H003 | H32R | no data | no data |
| Ab1H005m/Ab1L | H005 | P41R/G44R | 1.73 | 0.92 |
| Ab1H010/Ab1L | H010 | T77R | 1.68 | 1.05 |
| Ab1H012/Ab1L | H012 | D82aN/S82bR | 2.71 | 0.96 |
| Ab1H013/Ab1L | H013 | D82aG/S82bR | 2.95 | 1.02 |
| Ab1H014/Ab1L | H014 | D82aS/S82bR | 2.36 | 0.91 |
| Ab1H016/Ab1L | H016 | E85G | 1.51 | 1.04 |
| Ab1H018/Ab1L | H018 | A93K | 0.00 | −0.01 |
| Ab1H026m/Ab1L | H026 | P41R/G44R/T77R | 0.76 | no data |
| Ab1H027/Ab1L | H027 | T77R/D82aN/S82bR | 2.78 | 1.21 |
| Ab1H028/Ab1L | H028 | T77R/D82aG/S82bR | 3.04 | 1.37 |
| Ab1H029/Ab1L | H029 | T77R/D82aS/S82bR | 1.80 | 1.33 |
| Ab1H030/Ab1L | H030 | T77R/E85G | 1.50 | 1.27 |
| Ab1H031m/Ab1L | H031 | T77R/A93K | 0.03 | 0.06 |
| Ab1H032/Ab1L | H032 | D82aG/S82bR/E85G | 0.52 | no data |
| Ab1H034/Ab1L | H034 | Q13K | 1.12 | 1.21 |
| Ab1H035/Ab1L | H035 | G15R | 0.06 | 1.28 |
| Ab1H039/Ab1L | H039 | S64K | 0.77 | 1.57 |
| Ab1H041m/Ab1L | H041 | Q105R | 1.03 | 1.52 |
| Ab1H045/Ab1L | H045 | S82bR | 2.00 | 0.76 |

TABLE 33

Light Chain Variants of Ab1L evaluated in this Example

| Sample Name (H Chain/ L Chain) | Variant | | Imaging fold | BIACORE fold |
|---|---|---|---|---|
| Ab1H/Ab1L | Original Ab1 | | 1.00 | 1.00 |
| Ab1H/Ab1L001 | L001 | G16K | 2.11 | 1.03 |
| Ab1H/Ab1L002 | L002 | Q24R/E27Q | 1.43 | 1.03 |
| Ab1H/Ab1L003 | L003 | Q24R/E27R | 3.14 | 1.09 |
| Ab1H/Ab1L004 | L004 | Q24K/E27K | 1.42 | 1.01 |

TABLE 33-continued

Light Chain Variants of Ab1L evaluated in this Example

| Sample Name (H Chain/L Chain) | Variant | | Imaging fold | BIACORE fold |
|---|---|---|---|---|
| Ab1H/Ab1L005 | L005 | A25K/S26K | 1.82 | 0.84 |
| Ab1H/Ab1L006 | L006 | A25R/S26R | 6.82 | 1.18 |
| Ab1H/Ab1L007 | L007 | Q37R | 1.82 | 1.06 |
| Ab1H/Ab1L008 | L008 | G41R/Q42K | 1.70 | 1.07 |
| Ab1H/Ab1L009 | L009 | L46R/Y49K | 0.02 | −0.02 |
| Ab1H/Ab1L010 | L010 | S52R/S56R | 2.72 | 0.98 |
| Ab1H/Ab1L011 | L011 | S52R/S56K | 1.21 | 1.02 |
| Ab1H/Ab1L012 | L012 | S65R/T69R | 1.28 | 0.97 |
| Ab1H/Ab1L013 | L013 | T74K/S77R | 3.31 | 1.70 |
| Ab1H/Ab1L014 | L014 | S76R/Q79K | 4.47 | 1.08 |
| Ab1H/Ab1L015 | L015 | G16K/Q24R/E27R | 2.11 | 1.25 |
| Ab1H/Ab1L016 | L016 | Q24R/E27R/Q37R | 3.33 | 1.36 |
| Ab1H/Ab1L017 | L017 | Q24R/E27R/G41R/Q42K | 2.90 | 1.27 |
| Ab1H/Ab1L018 | L018 | Q24R/E27R/L46R/Y49K | 0.01 | 0.07 |
| Ab1H/Ab1L019 | L019 | Q24R/E27R/S52R/S56R | 3.88 | 1.17 |
| Ab1H/Ab1L020 | L020 | Q24R/E27R/S52K/S56K | 4.61 | 1.22 |
| Ab1H/Ab1L021 | L021 | Q24R/E27R/S65R/T69R | 11.43 | 1.36 |
| Ab1H/Ab1L022 | L022 | Q24R/E27R/T74K/S77R | 19.05 | 1.45 |
| Ab1H/Ab1L023 | L023 | Q24R/E27R/S76R/Q79K | 13.15 | 1.39 |
| Ab1H/Ab1L024 | L024 | G16K/A25R/S26R | 0.73 | No data |
| Ab1H/Ab1L025 | L025 | A25R/S26R/Q37R | 2.03 | 1.39 |
| Ab1H/Ab1L026 | L026 | A25R/S26R/G41R/Q42K | 1.28 | No data |
| Ab1H/Ab1L028 | L028 | A25R/S26R/S52R/S56R | 6.33 | 1.46 |
| Ab1H/Ab1L029 | L029 | A25R/S26R/S52K/S56K | 9.84 | 1.23 |
| Ab1H/Ab1L030 | L030 | A25R/S26R/S65R/T69R | 7.19 | 1.16 |
| Ab1H/Ab1L032 | L032 | A25R/S26R/S76R/Q79K | 2.67 | No data |
| Ab1H/Ab1L033 | L033 | Q24R/E27R/G41R/Q42K/S65R/T69R | 6.68 | 1.26 |
| Ab1H/Ab1L034 | L034 | Q24R/E27R/S52R/S56R/S65R/T69R | 9.81 | 1.71 |
| Ab1H/Ab1L035 | L035 | Q24R/E27R/S65R/T69R/T74K/S77R | 19.56 | 1.49 |
| Ab1H/Ab1L036 | L036 | Q24R/E27R/S65R/T69R/S76R/Q79K | 17.04 | 1.48 |
| Ab1H/Ab1L037 | L037 | Q24R/E27R/G41R/Q42K/T74K/S77R | 8.62 | 1.38 |
| Ab1H/Ab1L038 | L038 | Q24R/E27R/S52R/S56R/T74K/S77R | 15.13 | 1.47 |
| Ab1H/Ab1L039 | L039 | Q24R/E27R/T74K/S76R/S77R/Q79K | 26.95 | 0.99 |
| Ab1H/Ab1L040 | L040 | Q24R/E27R/G41R/Q42K/S76R/Q79K | 5.29 | 1.23 |
| Ab1H/Ab1L041 | L041 | Q24R/E27R/S52R/S56R/S76R/Q79K | 11.86 | 1.35 |
| Ab1H/Ab1L061 | L061 | Q42K/S76R | 4.86 | 1.02 |
| Ab1H/Ab1L062 | L062 | S65R/Q79K | 2.93 | 0.98 |

(21-2) Human FcγRIIb-Binding Assay by BIACORE Using pI-Increased Variants

Regarding the produced Fc region variant-containing antibodies, binding assays between soluble human FcγRIIb and antigen-antibody complexes were performed using BIACORE T200 (GE Healthcare). Soluble human FcγRIIb (NCBI accession NM_004001.3) was produced in the form of a His-tagged molecule by a method known in the art. An appropriate amount of an anti-His antibody was fixed onto Sensor chip CM5 (GE Healthcare) by the amine coupling method using a His capture kit (GE Healthcare) to capture human FcγRIIb. Next, an antibody-antigen complex and a running buffer (as a reference solution) were injected, and interaction was allowed to take place with the human FcγRIIb captured onto the sensor chip. 20 mM N-(2-Acetamido)-2-aminoethanesulfonic acid, 150 mM NaCl, 1.2 mM $CaCl_2$, and 0.05% (w/v) Tween 20 at pH 7.4 was used as the running buffer, and the respective buffer was also used to dilute the soluble human FcγRIIb. To regenerate the sensor chip, 10 mM glycine-HCl at pH 1.5 was used. All measurements were carried out at 25° C. Analyses were performed based on binding (RU) calculated from sensorgrams obtained by the measurements, and relative values when the binding amount of Ab1H/Ab1L (original Ab1) was defined as 1.00 are shown. To calculate the parameters, the BIACORE T100 Evaluation Software (GE Healthcare) was used.

The SPR analysis results are summarized in Tables 32 and 33. A few variants were shown to have enhanced binding toward human FcγRIIb fixed on the BIACORE sensor chip.

The antibodies produced by introducing the pI-increasing modification(s) into the variable region are antibodies in which the charge of the variable region is more positively charged when compared with those before introduction of the modification(s). Therefore, the Coulombic interaction between the variable region (positive charge) and the sensor chip surface (negative charge) can be considered to have been strengthened by the pI-increasing amino acid modifications. Furthermore, such effects are expected to take place similarly on the same negatively charged cell membrane surface; therefore, they are also expected to show an effect of accelerating the speed of uptake into cells in vivo.

Here, about 1.2 fold or more of the binding to hFcγRIIb of the variants compared to the binding to hFcγRIIb of original Ab1 was considered to have strong charge effect on binding of an antibody to hFcγRIIb on the sensor chip.

Among the pI-increased heavy chain variants, the antibody with Q13K, G15R, S64K, T77R, D82aN, D82aG, D82aS, S82bR, E85G or Q105R substitution(s) (according to Kabat numbering), alone or in combination, showed higher binding to hFcγRIIb. The single amino acid substitution or combination of these substitutions in heavy chain is supposed to have strong charge effect on binding to hFcγRIIb on the sensor chip. Thus, one or more of positions that are expected to show an effect of accelerating the speed or rate of uptake into cells in vivo by introducing the pI-increasing modification into the heavy chain variable region of an antibody can include, for example, positions 13, 15, 64, 77, 82a, 82b, 85 and 105 according to Kabat numbering. An amino acid substitution introduced at such position(s) can be asparagine, glycine, serine, arginine or lysine, and preferably arginine or lysine.

In pI-increased light chain variants, the antibody with G16K, Q24R, A25R, S26R, E27R, Q37R, G41R, Q42K, S52K, S52R, S56K, S56R, S65R, T69R, T74K, S76R, S77R, Q79K substitution(s) (according to Kabat numbering), alone or in combination, shows higher binding to human FcγRIIb. The single amino acid substitution or combination of these substitutions in light chain is supposed to have strong charge effect on binding to human FcγRIIb on the sensor chip. Thus, one or more of positions that are expected to show an effect of accelerating the speed or rate of uptake into cells in vivo by introducing the pI-increasing modification into the light chain variable region of an antibody can include, for example, positions 16, 24, 25, 26, 27, 37, 41, 42, 52, 56, 65, 69, 74, 76, 77, and 79 according to Kabat numbering. An amino acid substitution introduced at such position(s) can be arginine or lysine.

(21-3) Cellular Uptake of pI-Increased Fab Region Variant-Containing Antibodies

To evaluate the rate of intracellular uptake into an hFcγRIIb-expressing cell line using the produced Fab region variant-containing antibodies, the assay similar to (4-5) above was performed, provided that the amount of antigen taken up was presented as relative values to the Ab1H/Ab1L (original Ab1) value which is taken as 1.00.

The quantification results of cellular uptake were summarized in Tables 32 and 33. Strong fluorescence derived from the antigen in the cells was observed in several Fc variants. Here, about 1.5 fold or more of the fluorescence intensity of the antigen taken up into the cells of the variants compared to the fluorescence intensity of original Ab1 was considered to have strong charge effect on an antigen taken up into the cells.

Among the pI-increased heavy chain variants, the antibody with P41R, G44R, T77R, D82aN, D82aG, D82aS, S82bR or E85G substitution(s) (according to Kabat numbering), alone or in combination, showed stronger antigen uptake into the cells. The single amino acid substitution or combination of these substitutions in heavy chain is supposed to have strong charge effect on antigen antibody complex uptake into the cells. Thus, one or more of positions that are expected to cause uptake of an antigen-antibody complex into cells more quickly or more frequently by introducing the pI-increasing modification into the heavy chain variable region of an antibody can include, for example, positions 41, 44, 77, 82a, 82b or 85, according to Kabat numbering. An amino acid substitution introduced at such position(s) can be asparagine, glycine, serine, arginine or lysine, and preferably arginine or lysine.

In pI-increased light chain variants, the antibody with G16K, Q24R, A25R, A25K, S26R, S26K, E27R, E27Q, E27K, Q37R, G41R, Q42K, S52K, S52R, S56R, S65R, T69R, T74K, S76R, S77R or Q79K substitution(s) (according to Kabat numbering), alone or in combination, showed stronger antigen uptake into the cells. The single amino acid substitution or a combination of these substitutions in light chain is supposed to have strong charge effect on antigen antibody complex uptake into the cells. The variants with four or more amino acid substitutions tended to show stronger charge effect than those variants with lesser amino acid substitutions. One or more of positions that are expected to cause uptake of an antigen-antibody complex into cells more quickly or more frequently by introducing the pI-increasing modification into the light chain variable region of an antibody can include, for example, positions 16, 24, 25, 26, 27, 37, 41, 42, 52, 56, 65, 69, 74, 76, 77 or 79, according to Kabat numbering. An amino acid substitution introduced at such position(s) can be glutamine, arginine or lysine, and preferably arginine or lysine.

While not being restricted to a particular theory, this result can be explained as follows: the antigen and antibodies added to the cell culture solution form antigen-antibody complexes in the culture solution. The antigen-antibody complexes bind to human FcγRIIb expressed on the cell membrane via the antibody Fc region, and are taken up into the cells in a receptor-dependent manner. Antibodies used in this experiment binds to antigen in a pH-dependent manner; therefore, the antibody can dissociate from the antigen in the endosomes (acidic pH conditions) inside the cells. Since the dissociated antigen is transported to lysosome and accumulate, it fluoresces inside the cells. Thus, a strong fluorescence intensity inside the cell is thought to indicate that the uptake of the antigen-antibody complexes into the cells is taking place more quickly or more frequently.

(21-4) Evaluation of Clearance of Human IgE in Mouse Co-Injection Model

Some anti-IgE antibodies with pH-dependent antigen-binding (original Ab1, Ab1H/Ab1L013, Ab1H/Ab1L014, Ab1H/Ab1L007) were tested in mice co-injection model to evaluate their ability to accelerate the clearance of IgE from plasma. In co-injection model, C57BL6J mice (Jackson Laboratories) were administered by single i.v. injection with IgE pre-mixed with the anti-IgE antibody, respectively. All groups received 0.2 mg/kg IgE with 1.0 mg/kg of anti-IgE antibodies. Total IgE plasma concentration was determined by anti-IgE ELISA. First, anti-human IgE (clone 107, MABTECH) was dispensed into a microWell plate (Nalge nunc International), and left for two hours at room temperature or overnight at 4° C. to prepare an anti-human IgE antibody-immobilized plate. Samples for standard curve and samples were mixed with excess amount of the anti-IgE antibody (prepared in house) to form a uniform structure of immune complex. These samples were added into the anti-human IgE antibody-immobilized plate, and left for overnight at 4° C. Then, these samples were reacted with human GPC3 core protein (prepared in house), biotinized anti-GPC3 antibody (prepared in house), Streptavidin Poly HRP80 Conjugate (Stereospecific Detection Technologies) for one hour in order. After that, SuperSignal® ELISA Pico Chemiluminescent Substrate (Thermo Fisher Scientific) were added. Chemical luminescence was read with SpectraMax M2 (Molecular Devices). The concentration of human IgE was calculated using SOFTmax PRO (Molecular Devices). FIG. 37 describes the IgE plasma concentration time profile in C57BL6J mice.

After administration of pI-increased Fab variants with pH-dependent antigen-binding, plasma total IgE concentration was lower than that of original Ab1. These results indicate that the antigen-antibody immune complex of high pI variants with pH-dependent antigen-binding could bind more strongly to plasma membrane receptor such as FcγRs, which increase the cellular uptake of antigen-antibody immune complex. The antigen uptaken into the cells could release from antibody inside the endosome effectively, resulted in accelerated elimination of IgE. IgE concentration of mice treated with Ab1H/Ab1L007, which showed weak efficacy in vitro study, was higher than that of other pI-increase Fab variant-containing antibodies. These results also suggest that for speculating an evaluation of clearance of an antigen from plasma in vivo, the sensitivity of the in vitro system using the fluorescence intensity by InCell Analyzer 6000 described above may be higher than that of the in vitro BIACORE system described above.

Example 22

Evaluation of Clearance of C5 from Plasma Using pI-Increased Fab Variants

To enhance the clearance of human IgE, pI-increased substitutions in the Fab portion of an antibody were evaluated in this Example using pH-dependent antigen-binding antibodies.

(22-1) Preparation of C5 [Expression and Purification of Recombinant Human C5]

Recombinant human C5 (NCBI GenBank accession number: NP 001726.2, SEQ ID NO:207) was expressed transiently using FreeStyle293-F cell line (Thermo Fisher, Carlsbad, Calif., USA). Conditioned media expressing human C5 was diluted with equal volume of milliQ water, then applied to a Q-sepharose FF or Q-sepharose HP anion exchange column (GE healthcare, Uppsala, Sweden), followed by elution with NaCl gradient. Fractions containing human C5 were pooled, then salt concentration and pH was adjusted to 80 mM NaCl and pH6.4, respectively. The resulting sample was applied to a SP-sepharose HP cation exchange column (GE healthcare, Uppsala, Sweden) and eluted with a NaCl gradient. Fractions containing human C5 were pooled and subjected to CHT ceramic Hydroxyapatite column (Bio-Rad Laboratories, Hercules, Calif., USA). Human C5 eluate was then applied to a Superdex 200 gel filtration column (GE healthcare, Uppsala, Sweden). Fractions containing human C5 was pooled and stored at −150° C. Either in-house prepared recombinant human C5 or plasma derived human C5 (CALBIOCHEM, Cat#204888) was used for the study.

Expression and purification of recombinant cynomolgus monkey C5 (NCBI GenBank accession number: XP_005580972, SEQ ID NO:208) was done exactly the same way as the human counterpart.

(22-2) Preparation of Synthetic Calcium Library

A gene library of antibody heavy chain variable regions which were used as synthetic human heavy chain libraries consist of 10 heavy chain libraries. Germ-line frameworks VH1-2, VH1-69, VH3-23, VH3-66, VH3-72, VH4-59, VH4-61, VH4-b, VH5-51, and VH6-1 were selected for this library based on germ-line frequency in human B-cell repertoires, and biophysical properties of V-gene families. The synthetic human heavy chain library was diversified at the antibody-binding site mimicking human B cell antibody repertoires.

A gene library of antibody light chain variable regions were designed to have calcium binding motif and were diversified at the positions which would contribute to antigen recognition, referring to human B cell antibody repertoires. The design of a gene library of antibody light chain variable regions which exert characteristics for calcium-dependent binding to antigens is described in WO 2012/073992.

The combination of a heavy chain variable region library and a light chain variable region library is inserted in a phagemid vector, and a phage library was constructed, referring to (de Heard et al., *Meth. Mol. Biol.* 178:87-100 (2002)). A trypsin-cleavage site was introduced into the phagemid vector at a linker region between Fab and pIII protein. Modified M13K07 helper phage which has a trypsin-cleavage site between N2 and CT domains at geneIII was used for Fab displayed phage preparation.

(22-3) Isolation of Calcium Dependent Anti-C5 Antibodies

The phage display library was diluted with TBS supplemented with BSA and $CaCl_2$ at the final concentration of 4% and 1.2 mM, respectively. As a panning method, conventional magnetic beads selection was applied referring to general protocols (Junutula et al., *J. Immunol. Methods* 332(1-2):41-52 (2008), D'Mello et al., *J. Immunol. Methods* 247 (1-2):191-203 (2001), Yeung et al., *Biotechnol. Prog.* 18(2):212-220 (2002), Jensen et al., *Mol. Cell Proteomics* 2(2):61-69 (2003). As magnetic beads, NeutrAvidin coated beads (Sera-Mag SpeedBeads NeutrAvidin-coated) or Streptavidin coated beads (Dynabeads M-280 Streptavidin) were applied. Human C5 (CALBIOCHEM, Cat#204888) was labelled with EZ-Link NHS-PEG4-Biotin (PIERCE, Cat No. 21329).

The initial round of phage selection, the phage display library was incubated with biotinylated human C5 (312.5 nM) for 60 minutes at room temperature. Phages that displayed binding Fab variants were then captured using magnetic beads.

After incubation with beads for 15 minutes at room temperature, the beads were washed three times with 1 mL of TBS containing 1.2 mM $CaCl_2$ and 0.1% Tween 20, and the beads were washed twice with 1 mL of TBS containing 1.2 mM $CaCl_2$. Phages were eluted by re-suspending the beads with TBS containing 1 mg/mL trypsin for 15 minutes. The eluted phages were infected with ER2738 and rescued by the helper phage. The rescued phages were precipitated with polyethylene glycol, re-suspended with TBS supplemented with BSA and $CaCl_2$ at the final concentration of 4% and 1.2 mM, respectively and used in the next round of panning.

After 1st round of panning, the phages were selected for its calcium dependency, in which the antibody binds to C5 stronger in the presence of calcium ion. In the second and third round, the panning was performed in the same manner as the first round except by using 50 nM (second round) or 12.5 nM (third round) of biotinylated antigen and finally eluted with 0.1 mL of elution buffer (50 mM MES, 2 mM EDTA, 150 mM NaCl, pH5.5) and contacted with 1 µL of 100 mg/mL trypsin to select for its calcium dependency. After selection, selected phage clones were converted to IgG format.

Binding ability of converted IgG antibodies against human C5 were assessed under two different conditions: association and dissociation at 1.2 mM $CaCl_2$-pH 7.4 (20 mM MES, 150 mM NaCl, 1.2 mM $CaCl_2$) and association at 1.2 mM $CaCl_2$-pH 7.4 (20 mM MES, 150 mM NaCl, 1.2 mM $CaCl_2$) and dissociation at 3 µM $CaCl_2$-pH 5.8 (20 mM MES, 150 mM NaCl, 3 µM $CaCl_2$), at 30° C. using Octet RED384 system (Pall Life Sciences). 25 clones of pH-Calcium dependent antigen binding clones were isolated. The sensorgrams of these antibodies are shown in FIG. 38.

(22-4) Identification of Anti-C5 Bispecific Antibody

From the clones isolated in Example B-3, nine pH or calcium dependent anti-C5 antibody clones were selected for further analysis (CFP0008, 0011, 0015, 0016, 0017, 0018, 0019, 0020, 0021). Some amino acid substitutions were introduced to the CFP0016 heavy chain variable region by a method generally known to those of ordinary skill in the art to improve properties of the antibodies like physicochemical properties. This CFP0016 variant, CFP0016H019, was used for further analysis instead of CFP0016. The amino acid sequences of VH and VL regions of these nine antibodies are described in Table 34. In this table, names described in brackets represent the abbreviated names.

TABLE 34

Clone Name and Amino Acid Sequence of Selected Antibodies

| Clone Name | VH Name | VH SEQ ID | VL Name | VL SEQ ID |
|---|---|---|---|---|
| CFP0008 (08) | CFP0008H (08H) | NO: 209 | CFP0008L (08L) | NO: 210 |
| CFP0011 (11) | CFP0011H (11H) | NO: 211 | CFP0011L (11L) | NO: 212 |
| CFP0015 (15) | CFP0015H (15H) | NO: 213 | CFP0015L (15L) | NO: 214 |
| CFP0016H019 (16H019) | CFP0016H019 (16H019) | NO: 215 | CFP0016L (16L) | NO: 216 |
| CFP0017 (17) | CFP0017H (17H) | NO: 217 | CFP0017L (17L) | NO: 218 |
| CFP0018 (18) | CFP0018H (18H) | NO: 219 | CFP0018L (18L) | NO: 220 |
| CFP0019 (19) | CFP0019H (19H) | NO: 221 | CFP0019L (19L) | NO: 222 |
| CFP0020 (20) | CFP0020H (20H) | NO: 223 | CFP0020L (20L) | NO: 224 |
| CFP0021 (21) | CFP0021H (21H) | NO: 225 | CFP0021L (21L) | NO: 226 |

The full-length genes having nucleotide sequences encoding antibody heavy chain and light chain were synthesized and prepared by a method generally known to those of ordinary skill in the art. Heavy chain and light chain expression vectors were prepared by inserting the obtained plasmid fragments into vectors for expression in mammalian cells. The obtained expression vectors were sequenced by a method generally known to those of ordinary skill in the art. For expression of antibodies, the prepared plasmids were transiently transfected to FreeStyle293-F cell line (Thermo Fisher Scientific). Purification from the conditioned media expressing antibodies was conducted by a method generally known to those of ordinary skill in the art using rProtein A Sepharose Fast Flow (GE Healthcare).

(22-5) Generation and Characterization of pH Dependent Anti-05 Bispecific Antibody Bispecific antibodies, which recognize two different epitopes of C5, were generated by combination of CFP0020 and CFP0018. Bispecific antibody was prepared as IgG format having two different clones of Fab in each binding site of the antibody and was prepared using a method generally known to those of ordinary skill in the art. In this bispecific IgG antibody, two heavy chains comprise distinct heavy chain constant regions (G1dP1, SEQ ID NO:227 and G1dN1, SEQ ID NO:228) from each other so as to efficiently form a heterodimer of the two heavy chains. The anti-C5 bispecific antibody comprising the binding sites of anti-05 MAb "X" and anti-05 MAb "Y" is represented as "X//Y".

By introducing some amino acid substitutions into heavy chain and light chain CDR by a method generally known to those of ordinary skill in the art, we obtained light chain communization variant of 20//18, which we named 'optimized 20//18' (consisted by two heavy chains: CFP0020H0261-G1dP1, SEQ ID NO:229 and CFP0018H0012-G1dN1, SEQ ID NO:230 and common light chain: CFP0020L233-k0, SEQ ID NO:231).

The kinetics parameters of optimized 20//18 against recombinant human C5 were assessed under two different conditions (e.g. (A) association and dissociation at pH 7.4 and (B) association at pH 7.4 and dissociation at pH 5.8), at 37° C. using BIACORE T200 instrument (GE Healthcare). Protein A/G (Pierce, Cat No. #21186) or anti-human IgG (Fc) antibody (within Human Antibody Capture Kit; GE Healthcare, Cat No. BR-1008-39) was immobilized onto a Series S CM4 (GE Healthcare, Cat No. BR-1005-34) by amine coupling method. Anti-05 antibodies were captured on an immobilized molecule, and then human C5 was injected. The running buffers used were ACES pH 7.4 and pH 5.8 (20 mM ACES, 150 mM NaCl, 1.2 mM $CaCl_2$, 0.05% Tween 20). Kinetics parameters at both pH conditions were determined by fitting the sensorgrams with 1:1 binding-RI (without bulk effect adjustment) model using BIACORE T200 Evaluation software, version 2.0 (GE Healthcare). Kinetic parameters, association rate (ka), dissociation rate (kd), and binding affinity (KD) at pH 7.4, and dissociation rate (kd) determined by only calculating the dissociation phase at each pH conditions, are described in Table 35. Optimized 20//18 showed faster dissociation at pH 5.8 against human C5 compared with dissociation rate at pH 7.4.

TABLE 35

Kinetic Parameters of 20//18 Variants against Human C5 under two Different Conditions

|  | pH 7.4 | | | pH 7.4 | pH 5.8 |
|---|---|---|---|---|---|
|  | ka | kd | KD | kd (only dissociation) | |
| optimized 20//18 | 3.17E+05 | 1.87E−04 | 5.89E−10 | 1.36E−04 | 4.84E−02 |

(22-6) Production of Antibodies with Increased pI by Modification of Amino Acids in the Variable Region The tested antibodies are summarized in Tables 36 and 37.

The heavy chain, CFP0020H0261-001-G1dP1 (also called 20H001, SEQ ID NO:232) was prepared by introducing pI-increasing substitution P41R/G44R into CFP0020H0261-G1dP1 (SEQ ID NO:229). Similarly, the heavy chain, CFP0018H0012-002-GldN1 (also called 18H002, SEQ ID NO:251) was prepared by introducing pI-increasing substitution T77R/E85R into CFP0018H0012-G1dN1 (SEQ ID NO:230). Other heavy chain variants were also prepared by introducing respective substitutions represented in Table 36 into CFP0020H0261-G1dP1 and CFP0018H0012-G1dN1 respectively, according to the method shown in Reference Example 1. The heavy chain variants of both CFP0020H0261-G1dP1 variants and CFP0018H0012-G1dN1 variants were expressed with CFP0020L233-k0 (SEQ ID NO:231) as light chain to obtain bi-specific antibody.

Similarly, we also evaluated the pI-increasing substitution in light chain. The light chain, CFP0020L233-001-k0 (also called 20L233-001, SEQ ID NO:271) was prepared by introducing pI-increasing substitution G16K into CFP0020L233-k0. Other light chain variants were also prepared by introducing respective substitutions represented in Table 37 into CFP0020L233-k0 according to the method shown in Reference Example 1. All the light chain variants were expressed with CFP0020H0261-G1dP1 and CFP0018H0012-G1dN1 as heavy chain to obtain bi-specific antibody.

TABLE 36

Heavy Chain Variants of CFP0020H0261-001-G1dP1 and CFP0018H0012-001-G1dN1 evaluated in this Example

| Sample Name (Heavy Chain 1/Heavy Chain 2/Light Chain) | Variant | Mutation (Heavy Chain 1) | Mutation (Heavy Chain 2) | Imaging fold | BIACORE fold |
|---|---|---|---|---|---|
| CFP0020H0261-G1dP1/ CFP0018H0012-G1dN1/ CFP0020L233-k0 | original Ab2 | | | 1.00 | 1.00 |
| CFP0020H0261-001-G1dP1/ CFP0018H0012-002-G1dN1/ CFP0020L233-k0 | 20H001/ 18H002 | P41R/G44R | T77R/E85G | 2.27 | 0.91 |
| CFP0020H0261-002-G1dP1/ CFP0018H0012-002-G1dNl/ CFP0020L233-k0 | 20H002/ 18H002 | Q77R/A85R | T77R/E85G | 2.46 | 1.09 |
| CFP0020H0261-003-G1dP1/ CFP0018H0012-003-G1dN1/ CFP0020L233-k0 | 20H003/ 18H003 | L18R | G8R | 1.69 | 0.97 |
| CFP0020H0261-005-G1dP1/ CFP0018H0012-005-G1dN1/ CFP0020L233-k0 | 20H005/ 18H005 | S15R | G15R | 1.36 | 0.96 |
| CFP0020H0261-008-G1dP1/ CFP0018H0012-008-G1dN1/ CFP0020L233-k0 | 20H008/ 18H008 | G32R | Y32R | 0.00 | 0.20 |
| CFP0020H0261-009-G1dP1/ CFP0018H0012-009-G1dN1/ CFP0020L233-k0 | 20H009/ 18H009 | Q39K | Q39K | 1.45 | 1.01 |
| CFP0020H0261-013-G1dP1/ CFP0018H0012-013-G1dN1/ CFP0020L233-k0 | 20H013/ 18H013 | L63R | F63R | 2.64 | 1.52 |
| CFP0020H0261-G1dP1/ CFP0018H0012-014-G1dN1/ CFP0020L233-k0 | 20H/ 18H014 | — | Q64K | 0.86 | 0.80 |
| CFP0020H0261-G1dP1/ CFP0018H0012-016-G1dN1/ CFP0020L233-k0 | 20H/ 18H016 | — | F63R/Q64K | 1.90 | 1.08 |
| CFP0020H0261-018-G1dP1/ CFP0018H0012-018-G1dN1/ CFP0020L233-k0 | 20H018/ 18H018 | Q77R | T77R | 2.80 | 0.96 |
| CFP0020H0261-019-G1dP1/ CFP0018H0012-019-G1dN1/ CFP0020L233-k0 | 20H019/ 18H019 | L82K | L82K | 2.47 | 1.61 |
| CFP0020H0261-020-G1dP1/ CFP0018H0012-020-G1dN1/ CFP0020L233-k0 | 20H020/ 18H020 | S82aN/S82bR | S82aN/S82bR | 1.45 | 0.93 |
| CFP0020H0261-021-G1dP1/ CFP0018H0012-021-G1dN1/ CFP0020L233-k0 | 20H021/ 18H021 | S82aG/S82bR | S82aG/S82bR | 0.74 | 0.85 |
| CFP0020H0261-022-G1dP1/ CFP0018H0012-022-G1dN1/ CFP0020L233-k0 | 20H022/ 18H022 | S82bR | S82bR | 1.25 | 0.86 |
| CFP0020H0261-023-G1dP1/ CFP0018H0012-023-G1dN1/ CFP0020L233-k0 | 20H023/ 18H023 | V82cR | L82cR | 0.58 | 0.52 |
| CFP0020H0261-G1dP1/ CFP8810H0012-024-G1dN1/ CFP0020L233-k0 | 20H/ 18H024 | — | E85G | 0.99 | 0.72 |
| CFP0020H0261-025-G1dP1/ CFP0018H0012-025-G1dN1/ CFP0020L233-k0 | 20H025/ 18H025 | D86G | D86G | 0.68 | 0.76 |
| CFP0020H0261-026-G1dP1/ CFP0018H0012-026-G1dN1/ CFP0020L233-k0 | 20H026/ 18H026 | A93K | A93K | 0.01 | 0.23 |
| CFP0020H0261-G1dP1/ CFP0018H0012-027-G1dN1/ CFP0020L233-k0 | 20H/ 18H027 | — | Q105R | 1.22 | 0.79 |
| CFP0020H0261-032-G1dP1/ CFP0018H0012-032-G1dN1/ CFP0020L233-k0 | 20H032/ 18H032 | L82K/S82bR | L82K/S82bR | 1.47 | 2.25 |
| CFP0020H0261-035-G1dP1/ CFP0018H0012-G1dN1/ CFP0020L233-k0 | 20H035/ 18H | S82bR/T83R | — | 1.03 | 1.15 |
| CFP0020H0261-036-G1dP1/ CFP0018H0012-G1dN1/ CFP0020L233-k0 | 20H036/ 18H | T83R | — | 2.02 | 1.05 |
| CFP0020H0261-037-G1dP1/ CFP0018H0012-037-G1dN1/ CFP0020L233-k0 | 20H037/ 18H037 | V71R/A85R | A71R/E85G | 0.34 | 0.49 |

TABLE 37

Light Chain Variants of CFP0020L233 evaluated in this Example

| Sample Name | Variant | Mutation | Imaging fold | BIACORE fold |
|---|---|---|---|---|
| CFP0020H0261-G1dP1/ CFP0018H0012-G1dN1/ CFP0020L233-k0 | original Ab2 | | 1.00 | 1.00 |
| CFP0020H0261-G1dP1/ CFP0018H0012-G1dN1/ CFP0020L233-001-k0 | 20L233-001 | G16K | 2.20 | 1.59 |
| CFP0020H0261-G1dP1/ CFP0018H0012-G1dN1/ CFP0020L233-002-k0 | 20L233-002 | Q27R | 1.08 | 0.92 |
| CFP0020H0261-G1dP1/ CFP0018H0012-G1dN1/ CFP0020L233-003-k0 | 20L233-003 | A25R/S26R | 0.38 | 0.32 |
| CFP0020H0261-G1dP1/ CFP0018H0012-G1dN1/ CFP0020L233-004-k0 | 20L233-004 | S52K/S56K | 1.24 | 0.75 |
| CFP0020H0261-G1dP1/ CFP0018H0012-G1dN1/ CFP0020L233-005-k0 | 20L233-005 | T74K/S77R | 3.32 | 1.83 |
| CFP0020H0261-G1dP1/ CFP0018H0012-G1dN1/ CFP0020L233-006-k0 | 20L233-006 | S76R/Q79K | 4.85 | 1.89 |
| CFP0020H0261-G1dP1/ CFP0018H0012-G1dN1/ CFP0020L233-007-k0 | 20L233-007 | Q27K | 1.18 | 0.95 |
| CFP0020H0261-G1dP1/ CFP0018H0012-G1dN1/ CFP0020L233-008-k0 | 20L233-008 | A25K/S26K | 0.29 | 0.29 |
| CFP0020H0261-G1dP1/ CFP0018H0012-G1dN1/ CFP0020L233-009-k0 | 20L233-009 | Q37R | 0.99 | 0.78 |
| CFP0020H0261-G1dP1/ CFP0018H0012-G1dN1/ CFP0020L233-010-k0 | 20L233-010 | G41R | 1.77 | 1.01 |
| CFP0020H0261-G1dP1/ CFP0018H0012-G1dN1/ CFP0020L233-011-k0 | 20L233-011 | L46R/Y49K | 0.00 | 0.14 |
| CFP0020H0261-G1dP1/ CFP0018H0012-G1dN1/ CFP0020L233-012-k0 | 20L233-012 | S52R/S56R | 1.02 | 0.68 |
| CFP0020H0261-G1dP1/ CFP0018H0012-G1dN1/ CFP0020L233-013-k0 | 20L233-013 | S65R/T69R | 1.24 | No data |
| CFP0020H0261-G1dP1/ CFP0018H0012-G1dN1/ CFP0020L233-016-k0 | 20L233-016 | G41R/T74K/S77R | 6.58 | 1.96 |
| CFP0020H0261-G1dP1/ CFP0018H0012-G1dN1/ CFP0020L233-017-k0 | 20L233-017 | L46R/Y49K/T74K/S77R | 0.00 | 0.18 |
| CFP0020H0261-G1dP1/ CFP0018H0012-G1dN1/ CFP0020L233-018-k0 | 20L233-018 | S52R/S56R/T74K/S77R | 46.97 | 1.43 |
| CFP0020H0261-G1dP1/ CFP0018H0012-G1dN1/ CFP0020L233-019-k0 | 20L233-019 | S65R/T69R/T74K/S77R | 53.25 | 7.72 |
| CFP0020H0261-G1dP1/ CFP0018H0012-G1dN1/ CFP0020L233-021-k0 | 20L233-021 | Q27R/S76R/Q79K | 20.90 | 1.77 |
| CFP0020H0261-G1dP1/ CFP0018H0012-G1dN1/ CFP0020L233-022-k0 | 20L233-022 | G41R/S76R/Q79K | 27.3 | 2.04 |
| CFP0020H0261-G1dP1/ CFP0018H0012-G1dN1/ CFP0020L233-023-k0 | 20L233-023 | L46R/Y49K/S76R/Q79K | 0.2 | 0.18 |
| CFP0020H0261-G1dP1/ CFP0018H0012-G1dN1/ CFP0020L233-024-k0 | 20L233-024 | S52R/S56R/S76R/Q79K | 114.7 | 2.16 |
| CFP0020H0261-G1dP1/ CFP0018H0012-G1dN1/ CFP0020L233-025-k0 | 20L233-025 | S65R/T69R/S76R/Q79K | 75.6 | 3.18 |
| CFP0020H0261-G1dP1/ CFP0018H0012-G1dN1/ CFP0020L233-027-k0 | 20L233-027 | Q27R/G41R/T74K/S77R | 4.1 | 2.24 |
| CFP0020H0261-G1dP1/ CFP0018H0012-G1dN1/ CFP0020L233-028-k0 | 20L233-028 | G41R/S52R/S56R/T74K/S77R | 18.1 | 1.94 |

TABLE 37-continued

Light Chain Variants of CFP0020L233 evaluated in this Example

| Sample Name | Variant | Mutation | Imaging fold | BIACORE fold |
|---|---|---|---|---|
| CFP0020H0261-G1dP1/ CFP0018H0012-G1dN1/ CFP0020L233-029-k0 | 20L233-029 | G41R/S65R/T69R/T74K/S77R | 28.8 | 9.63 |
| CFP0020H0261-G1dP1/ CFP0018H0012-G1dN1/ CFP0020L233-031-k0 | 20L233-031 | Q27R/S52R/S56R/T74K/S77R | 21.0 | 1.78 |
| CFP0020H0261-G1dP1/ CFP0018H0012-G1dN1/ CFP0020L233-032-k0 | 20L233-032 | S52R/S56R/S65R/T69R/T74K/S77R | 64.1 | 11.09 |
| CFP0020H0261-G1dP1/ CFP0018H0012-G1dN1/ CFP0020L233-034-k0 | 20L233-034 | Q27R/S65R/T69R/T74K/S77R | 30.5 | 8.61 |
| CFP0020H0261-G1dP1/ CFP0018H0012-G1dN1/ CFP0020L233-036-k0 | 20L233-036 | Q27R/G41R/S76R/Q79K | 14.5 | 2.45 |
| CFP0020H0261-G1dP1/ CFP0018H0012-G1dN1/ CFP0020L233-037-k0 | 20L233-037 | G41R/S52R/S56R/S76R/Q79K | 53.0 | 2.43 |
| CFP0020H0261-G1dP1/ CFP0018H0012-G1dN1/ CFP0020L233-038-k0 | 20L233-038 | G41R/S65R/T69R/S76R/Q79K | 45.9 | 4.24 |
| CFP0020H0261-G1dP1/ CFP0018H0012-G1dN1/ CFP0020L233-040-k0 | 20L233-040 | Q27R/S52R/S56R/S76R/Q79K | 61.6 | 2.32 |
| CFP0020H0261-G1dP1/ CFP0018H0012-G1dN1/ CFP0020L233-041-k0 | 20L233-041 | S52R/S56R/S65R/T69R/S76R/Q79K | 96.2 | 5.28 |
| CFP0020H0261-G1dP1/ CFP0018H0012-G1dN1/ CFP0020L233-043-k0 | 20L233-043 | Q27R/S65R/T69R/S76R/Q79K | 49.3 | 3.51 |
| CFP0020H0261-G1dP1/ CFP0018H0012-G1dN1/ CFP0020L233-044-k0 | 20L233-044 | S76R | 1.61 | 1.25 |
| CFP0020H0261-G1dP1/ CFP0018H0012-G1dN1/ CFP0020L233-045-k0 | 20L233-045 | S65R/Q79K | 3.66 | 1.46 |

(22-7) Human FcγRIIb-Binding Assay by BIACORE Using pI-Increased Variants

Regarding the produced Fc region variant-containing antibodies, binding assays between soluble hFcγRIIb and antigen-antibody complexes were performed using BIACORE T200 (GE Healthcare). Soluble hFcγRIIb was produced in the form of a His-tagged molecule by a method known in the art. An appropriate amount of an anti-His antibody was fixed onto Sensor chip CM5 (GE Healthcare) by the amine coupling method using a His capture kit (GE Healthcare) to capture hFcγRIIb. Next, an antibody-antigen complex and a running buffer (as a reference solution) were injected, and interaction was allowed to take place with the hFcγRIIb captured onto the sensor chip. 20 mM N-(2-Acetamido)-2-aminoethanesulfonic acid, 150 mM NaCl, 1.2 mM $CaCl_2$, and 0.05% (w/v) Tween 20 at pH 7.4 was used as the running buffer, and the respective buffer was also used to dilute the soluble hFcγRIIb. To regenerate the sensor chip, 10 mM glycine-HCl at pH 1.5 was used. All measurements were carried out at 25° C. Analyses were performed based on binding (RU) calculated from sensorgrams obtained by the measurements, and relative values when the binding amount of CFP0020H0261-G1dP1/CFP0018H0012-G1dN1/CFP0020L233-k0 (original Ab2) was defined as 1.00 are shown. To calculate the parameters, the BIACORE T100 Evaluation Software (GE Healthcare) was used.

The SPR analysis results are summarized in Tables 36 and 37. A few variants were shown to have enhanced binding toward hFcγRIIb fixed on the BIACORE sensor chip. Here, about 1.2 fold or more of the binding to hFcγRIIb of the variants compared to the binding to hFcγRIIb of original Ab2 was considered to have strong charge effect on binding of an antibody to hFcγRIIb on the sensor chip.

Among the pI-increased heavy chain variants, the antibody with L63R, F63R, L82K or S82bR substitutions (according to Kabat numbering) showed higher binding to hFcγRIIb. The single amino acid substitution or a combination of these substitutions in heavy chain is supposed to have strong charge effect on binding to hFcγRIIb on the sensor chip. Thus, one or more of positions that are expected to show an effect of accelerating the speed or rate of uptake into cells in vivo by introducing the pI-increasing modification into the heavy chain variable region(s) of an antibody can include, for example, position 63, 82 or 82b according to Kabat numbering. An amino acid substitution introduced at such position(s) can be arginine or lysine.

In the pI-increased light chain variants, the antibody with G16K, Q27R, G41R, S52R, S56R, S65R, T69R, T74K, S76R, S77R or Q79K substitutions (according to Kabat numbering) showed higher binding to hFcγRIIb. The single amino acid substitution or a combination of these substitutions in light chain is supposed to have strong charge effect on binding to human FcγRIIb on the sensor chip. Thus, one or more of positions that are expected to show an effect of accelerating the speed or rate of uptake into cells in vivo by introducing the pI-increasing modification into the light chain variable region of an antibody can include, for example, positions 16, 27, 41, 52, 56, 65, 69, 74, 76, 77 or 79, according to Kabat numbering. An amino acid substitution introduced at such position(s) can be arginine or lysine. The variants with four or more amino acid substitutions tended to show stronger charge effect than those variants with lesser amino acid substitutions.

(22-8) Cellular Uptake of pI-Increased Fab Region Variant-Containing Antibodies

To evaluate the rate of intracellular uptake into an hFcγRIIb-expressing cell line using the produced Fab region variant-containing antibodies, the following assay was performed.

An MDCK (Madin-Darby canine kidney) cell line that constitutively expresses hFcγRIIb was produced by known methods. Using these cells, intracellular uptake of antigen-antibody complexes was evaluated. Specifically, Alexa555 (Life Technlogies) was used to label human C5 according to an established protocol, and antigen-antibody complexes were formed in a culture solution with the antibody concentration being 10 mg/mL and the antigen concentration being 10 mg/mL. The culture solution containing the antigen-antibody complexes was added to culture plates of the above-mentioned MDCK cells which constitutively express hFcγRIIb and incubated for one hour, and then the fluorescence intensity of the antigen taken up into the cells was quantified using InCell Analyzer 6000 (GE healthcare). The amount of antigen taken up was presented as relative values to the original Ab2 value which is taken as 1.00.

The quantification results of cellular uptake were summarized in Tables 36 and 37. Strong fluorescence derived from the antigen in the cells was observed in several heavy chain and light chain variants. Here, about 1.5 fold or more of the fluorescence intensity of the antigen taken up into the cells of the variants compared to the fluorescence intensity of original Ab2 was considered to have strong charge effect on an antigen taken up into the cells.

Among the pI-increased heavy chain variants, the antibody with G8R, L18R, Q39K, P41R, G44R, L63R, F63R, Q64K, Q77R, T77R, L82K, S82aN, S82bR, T83R, A85R or E85G substitution(s) (according to Kabat numbering) showed stronger antigen uptake into the cells. The single amino acid substitution or a combination of these substitutions in heavy chain is supposed to have strong charge effect on antigen antibody complex uptake into the cells. Thus, one or more of positions that are expected to cause uptake of an antigen-antibody complex into cells more quickly or more frequently by introducing the pI-increasing modification into the heavy chain variable region(s) of an antibody can include, for example, positions 8, 18, 39, 41, 44, 63, 64, 77, 82, 82a, 82b, 83, or 85, according to Kabat numbering. An amino acid substitution introduced at such position(s) can be asparagine, glycine, serine, arginine or lysine, and preferably arginine or lysine.

In the pI-increased light chain variants, the antibody with G16K, Q27R, S27R, G41R, S52R, S56R, S65R, T69R, T74K, S76R, S77R or Q79K substitutions (according to Kabat numbering) showed stronger antigen uptake into the cells. The single amino acid substitution or a combination of these substitutions in light chain is supposed to have strong charge effect on antigen antibody complex uptake into the cells. The variants with four or more amino acid substitutions tended to show stronger charge effect than those variants with lesser amino acid substitutions. As shown in Example 21, (21-3), the combination of 42K and 76R substitution is effective in IgE antibody. In the case of C5 antibody, however, the amino acid of Kabat numbering 42 is already lysine, so we can observe the charge effect of 42K/76R by the single substitution of 76R. The fact that the variant with 76R substitution had strong charge effect also in C5 antibody shows the combination of 42K/76R has strong charge effect regardless of antigen. Thus, one or more of positions that are expected to cause uptake of an antigen-antibody complex into cells more quickly or more frequently by introducing the pI-increasing modification into the light chain variable region(s) of an antibody can include, for example, positions 16, 27, 41, 52, 56, 65, 69, 74, 76, 77 or 79, according to Kabat numbering. An amino acid substitution introduced at such position(s) can be arginine or lysine.

(22-9) Evaluation of Clearance of C5 in Mouse Co-Injection Model

Some anti-C5 bispecific antibodies (original Ab2, 20L233-005, 20L233-006 and 20L233-009) were tested in mice co-injection model to evaluate their ability to accelerate the clearance of C5 from plasma. In co-injection model, C57BL6J mice (Jackson Laboratories) were administered by single i.v. injection with C5 pre-mixed with the anti-C5 bispecific antibody, respectively. All groups received 0.1 mg/kg C5 with 1.0 mg/kg of anti-C5 bispecific antibodies. Total C5 plasma concentration was determined by anti-C5 ECLIA. First, anti-human C5 mouse IgG was dispensed into an ECL plate, and left for overnight at 5° C. to prepare an anti-human C5 mouse IgG-immobilized plate. Samples for standard curve and samples were mixed with an anti-human C5 rabbit IgG. These samples were added into the anti-human C5 mouse IgG-immobilized plate, and left for one hour at room temperature. Then, these samples were reacted with HRP-conjugated anti-rabbit IgG (Jackson Immuno Research). After the plate was incubated for one hour at room temperature, a sulfo-tag conjugated anti-HRP were added. ECL signal was read with Sector Imager 2400 (Meso Scale discovery). The concentration of human C5 was calculated from the ECL signal in the standard curve using SOFTmax PRO (Molecular Devices). FIG. 39 describes the C5 plasma concentration time profile in C57BL6J mice.

Compared to original Ab2, all of the bispecific antibodies with pI-increased substitution(s) tested in this study demonstrated rapid C5 clearance from plasma. Therefore, amino acid substitution(s) on T74K/S77R, S76R/Q79K and Q37R in light chain are suggested to accelerate elimination of C5-antibody immune complex also in vivo. Furthermore, C5 elimination of 20L233-005 and 20L233-006 was faster than that of 20L233-009, that was consistent with in vitro imaging and BIACORE analysis. These results suggest that even the position(s) which seems unlikely to contribute for clearance of an antigen from plasma in vivo, examined under either the in vitro system using the fluorescence intensity by InCell Analyzer 6000 or the in vitro BIACORE system described above, can be found out to contribute for that by using the more sensitive in vivo system. These results also suggest that for speculating an evaluation of clearance of an antigen from plasma in vivo, the sensitivity of the in vitro system using the fluorescence intensity by InCell Analyzer 6000 described above may be higher than that of the in vitro BIACORE system described above.

Example 23

Evaluation of Clearance of IgE from Plasma Using pI-Increased Fc Variants

To enhance the clearance of human IgE or human C5, pI-increased substitutions in the Fc portion of antibodies were evaluated using pH dependent antibodies. The method of adding amino acid substitutions to the antibody constant region to increase pI is not particularly limited, but for example, it can be performed by the method described in WO2014/145159.

(23-1) Production of Antibodies with Increased-pI by a Single Amino Acid Modification in the Constant Region The tested antibodies are summarized in Table 38. The heavy chain, Ab1H-P1394m (SEQ ID NO:307) was prepared by introducing a pI-increasing substitution Q311K into Ab1H. Other heavy chain variants were also prepared by introducing respective substitutions represented in Table 38 into Ab1H according to the method shown in Reference Example 1. All the heavy chain variants were expressed with Ab1L as light chain.

TABLE 38

| Antibody Name (Heavy Chain/ Light Chain) | Variant | Mutation | Imaging fold | BIACORE fold |
|---|---|---|---|---|
| Ab1H/Ab1L | original Ab1 | — | 1.00 | 1.00 |
| Ab1H-P1394m/Ab1L | P1394m | Q311K | 1.31 | 1.18 |
| Ab1H-P1398m/Ab1L | P1398m | D413K | 3.45 | 1.23 |
| Ab1H-P1466m/Ab1L | P1466m | Q311R | 1.90 | 1.22 |
| Ab1H-P1468m/Ab1L | P1468m | N315R | 1.42 | 1.13 |
| Ab1H-P1469m/Ab1L | P1469m | N315K | 1.93 | 1.13 |
| Ab1H-P1470m/Ab1L | P1470m | N384R | 1.50 | 1.19 |
| Ab1H-P1471m/Ab1L | P1471m | N384K | 0.71 | 1.19 |
| Ab1H-P1480m/Ab1L | P1480m | Q342R | 1.08 | 1.03 |
| Ab1H-P1481m/Ab1L | P1481m | Q342K | 1.83 | 1.08 |
| Ab1H-P1482m/Ab1L | P1482m | P343R | 4.90 | 1.46 |
| Ab1H-P1483m/Ab1L | P1483m | P343K | 1.99 | 1.02 |
| Ab1H-P1512m/Ab1L | P1512m | D401R | 2.98 | 1.24 |
| Ab1H-P1513m/Ab1L | P1513m | D401K | 2.57 | 1.21 |
| Ab1H-P1514m/Ab1L | P1514m | G402R | 1.22 | 1.20 |
| Ab1H-P1515m/Ab1L | P1515m | G402K | 0.93 | 1.19 |
| Ab1H-P1653m/Ab1L | P1653m | D413R | 3.96 | 0.79 |

(23-2) Human FcγRIIb-Binding Assay by BIACORE Using pI-Increased Fc Region Variant-Containing Antibodies To evaluate the charge effect on FcRγRIIb-binding of antigen-antibody complex formed by using the antibodies described in Table 38, FcRγRIIb-binding assay was performed in a similar manner with those described in Example 21, (21-2). Assay results are shown in Table 38. Here, about 1.2 fold or more of the binding to hFcγRIIb of the variants compared to the binding to hFcγRIIb of original Ab1 was considered to have strong charge effect on binding of an antibody to hFcγRIIb on the sensor chip.

Among the pI-increased variants with a single amino acid substitution from original Ab1, the antigen-antibody complex made by several variants such as P1398m, P1466m, P1482m, P1512m, P1513m, and P1514m showed highest binding to hFcγRIIb. The single amino acid substitution on D413K, Q311R, P343R, D401R, D401K, G402R, Q311K, N384R, N384K, or G402K is supposed to have strong charge effect on binding to hFcγRIIb on the sensor chip. Thus, a single position that is expected to show an effect of accelerating the speed or rate of uptake into cells in vivo by introducing the pI-increasing modification into the constant or Fc region of an antibody can include, for example, positions 311, 343, 384, 401, 402, or 413, according to EU numbering. An amino acid substitution introduced at such position can be arginine or lysine.

(23-3) Cellular Uptake of pI-Increased Fc Region Variant-Containing Antibodies

To evaluate the intracellular uptake of antigen-antibody complex formed by the antibodies described in Table 38, cell imaging assay was performed in a similar manner with those described in Example 21, (21-3). Assay results are shown in Table 38. Here, about 1.5 fold or more of the fluorescence intensity of the antigen taken up into the cells of the variants compared to the fluorescence intensity of original Ab1 was considered to have strong charge effect on an antigen taken up into the cells.

Among the pI-increased variants with a single amino acid substitution from original Ab1, the antigen-antibody complex made by several variants such as P1398m, P1466m, P1469m, P1470m, P1481m, P1482m, P1483m, P1512m, P1513m and P1653m showed stronger antigen uptake into the cells. The single amino acid substitution on D413K, Q311R, N315K, N384R, Q342K, P343R, P343K, D401R, D401K or D413R is supposed to have strong charge effect on antigen antibody complex uptake into the cells. Thus, a single position that is expected to cause uptake of an antigen-antibody complex into cells more quickly or more frequently by introducing the pI-increasing modification into the constant or Fc region of an antibody can include, for example, positions 311, 315, 342, 343, 384, 401, or 413, according to EU numbering. An amino acid substitution introduced at such position can be arginine or lysine.

(23-4) Evaluation of Clearance of Human IgE in Mouse Co-Injection Model

Some anti-IgE antibodies with pH-dependent antigen-binding (original Ab1, P1466m, P1469m, P1470m, P1480m, P1482m, P1512m, P1653m) were tested in mice co-injection model to evaluate their ability to accelerate the clearance of IgE from plasma. The assays were performed in a similar way with Example 21, (21-4). FIG. 40 describes the plasma concentration time profile in C57BL6J mice.

After administration of high pI variants (only a single amino acid substitution) with pH-dependent antigen-binding, the plasma total IgE concentration was lower than that of original Ab1 except for P1480m. P1480m, which showed weak efficacy the both in vitro studies, did not accelerate elimination of IgE. Furthermore, the plasma total IgE concentration in mice treated with high pI variant without pH-dependent antigen-binding was significantly higher than that of high pI variant with pH-dependent antigen-binding (data not shown). These results indicate that the cellular uptake of antigen-antibody immune complex increase by introducing the pI-increasing modification. The antigen uptaken into the cells in complex with a pH-dependent antigen-binding antibody could release from antibody inside endosome effectively, resulted in accelerated elimination of IgE. These results suggest that even the substituted position which seems unlikely to contribute for clearance of an antigen from plasma in vivo, examined under the in vitro BIACORE system described above, can be found out to contribute for that by using the more sensitive in vivo system. These results also suggest that for speculating an evaluation of clearance of an antigen from plasma in vivo, the sensitivity of the in vitro system using the fluorescence intensity by InCell Analyzer 6000 described above may be higher than that of the in vitro BIACORE system described above.

Reference Example 1

Construction of Expression Vectors of Amino Acid-Substituted IgG Antibodies

Mutants were prepared using the QuikChange Site-Directed Mutagenesis Kit (Stratagene) by the method described in the appended instruction manual. Plasmid fragments containing the mutants were inserted into animal cell expression vectors to construct desired H-chain and L-chain expression vectors. The nucleotide sequences of the obtained expression vectors were determined by methods known in the art.

Reference Example 2

Expression and Purification of IgG Antibodies

Antibodies were expressed using the following method. The human embryonic kidney cancer cell-derived HEK293H cell line (Invitrogen) was suspended in DMEM medium (Invitrogen) supplemented with 10% Fetal Bovine Serum (Invitrogen). The cells were plated at 10 mL per dish in dishes for adherent cells (10 cm in diameter; CORNING) at a cell density of 5 to $6 \times 10^5$ cells/mL and cultured in a $CO_2$ incubator (37° C., 5% $CO_2$) for one day. Then, the medium was removed by aspiration, and 6.9 mL of CHO-S-SFM-II medium (Invitrogen) was added. The prepared plasmid was introduced into the cells by the lipofection method. The resulting culture supernatants were collected, centrifuged (approximately 2,000 g, 5 minutes, room temperature) to remove cells, and sterilized by filtering through the 0.22-μm filter MILLEX (registered trademark)-GV (Millipore) to obtain supernatants. Antibodies were purified from the obtained culture supernatants by methods known in the art using the rProtein A Sepharose™ Fast Flow (Amersham Biosciences). To determine the concentration of the purified antibody, absorbance was measured at 280 nm using a spectrophotometer. Antibody concentrations were calculated from the determined values using an absorbance coefficient calculated by the method described in Pace et al., *Protein Science* 4:2411-2423 (1995).

Reference Example 3

Preparation of a Soluble Human IL-6 Receptor

A recombinant soluble human IL-6 receptor, which is an antigen, was prepared in the manner described below. A CHO cell line that constitutively expresses soluble human IL-6 receptor composed of an amino acid sequence of the 1st to 357th amino acid from the N terminus as reported in Mullberg et al., *J. Immunol.* 152:4958-4968 (1994) was constructed using a method known in the art. Soluble human IL-6 receptor was expressed by culturing this CHO line. Soluble human IL-6 receptor was purified from the culture supernatant of the obtained CHO line in two steps: Blue Sepharose 6 FF column chromatography and a gel filtration column chromatography. The fraction that was eluted as the main peak in the final step was used as the final purified product.

SEQUENCE LISTING (332 sequences)

SEQ ID NO: 1 - protein, 107 aa, Artificial Sequence
  Vk1
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 2 - protein, 112 aa, Artificial Sequence
  Vk2
DIVMTQSPLSLPVTPGEPASISCRSSQSLLHSNGDNYLDWYLQKPGQSPQLLIYLGSNRASGVPDRFSGSGSGTDFTLKISRVEAEDVGVYYCMQVLRNPLTFGGGTKVEIQ

SEQ ID NO: 3 - protein, 107 aa, Artificial Sequence
  Vk3
EIVMTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIK

SEQ ID NO: 4 - protein, 112 aa, Artificial Sequence
  Vk4
DIVMTQSPESLVLSLGGTATINCRSSQSVLYSSNNKNYLTWYQQKPGQPPTLLFSWASIRDSGVPDRFSASGSGTEFTLTISDLQAEDAAVYYCQQYYRAPSFGQGTKLQIK

SEQ ID NO: 5 - protein, 121 aa, Artificial Sequence
  6RL#9-IgG1
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDPGGGEYYFDYWGQGTLVTVSS

SEQ ID NO: 6 - protein, 126 aa, Artificial Sequence
  6KC4-1#85-IgG1
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDAPYYYDSSGYTDAFDIWGQGTMVTVSS

SEQ ID NO: 7 - protein, 107 aa, Artificial Sequence
  Calcium-Binding Domain
ETTLTQSPAFMSATPGDKVNISCKASQDIDDDMNWYQQKPGEAAIFIIQEATTLVPGISPRFSGSGYGTDFTLTINNIESEDAAYYFCLQHDNFPYTFGQGTKLEIK

SEQ ID NO: 8 - protein, 115 aa, Homo Sapian
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSS

SEQ ID NO: 9 - protein, 112 aa, Homo Sapian
DVVMTQSPLSLPVTPGEPASISCRSSQSLVHSNRNTYLHWYLQKPGQSPQLLIYKVSNRFSGVPDRFSGSGSGTDFTLKISRVEAEDVGVYYCSQNTHVPPTFGQGTKLEIK

SEQ ID NO: 10 - protein, 449 aa, Homo Sapian
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARVLARITAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 214 aa, Homo Sapian
DIQMTQSPSSLSASVGDRVTITCRASQDISSYLNWYQQKPGKAPKLLIYYTSRLHSGVPSRFSGSGSGTDFTFTISSLQPEDIATYYCGQGNRLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - protein, 433 aa, Homo Sapian
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 214 aa, Homo Sapian [sequence omitted]

SEQ ID NO: 14 - protein, 445 aa, Homo Sapian
QVQLVQSGAEVKKPGASVKVSCKASGYTFTDYEMHWIRQPPGKGLEWIGAINPKTGDTAYSQKFKGRVTLTADKSTSTAYMELSSLTSEDTAVYYCTRFYSYTYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 219 aa, Homo Sapian
DIVMTQSPLSLPVTPGQPASISCRASRSLVHSNRNTYLHWYQQKPGQAPRLLIYKVSNRFSGVPDRFSGSGSGTDFTLKISRVEAEDVGVYYCSQNTHVPPTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 447 aa, Homo Sapian
QVQLVQSGAEVKKPGASVKVSCKASGYTFTGYIMNWVRQAPGQGLEWMGLINPYNGGTSYNQKFKGRVTITADESTSTAYMELSSLRSEDTAVYYCARDGYDDGPYTMDYWGQGTLVTVSSASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17 - protein, 214 aa, Homo Sapian
DIQMTQSPSSLSASVGDRVTITCRTSENIYSFLAWYQQKPGKAPKLLIYNAKTLAKGVPSRFSGSGSGTDFTLTISSLQPEDFATYYCQHHYESPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 330 aa, Homo Sapian [sequence omitted]

SEQ ID NO: 19 - protein, 326 aa, Homo Sapian
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 20 - protein, 377 aa, Homo Sapian
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 21 - protein, 327 aa, Homo Sapian
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 22 - protein, 107 aa, Homo Sapian [sequence omitted]

SEQ ID NO: 23 - protein, 105 aa, Homo Sapian
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 24 - protein, 447 aa, Artificial Sequence
  VH3-IgG1
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 447 aa, Artificial Sequence
  VH3(High_pI)-IgG1
QVQLQESGPGLVKPSQTLSLTCAVSGHSISHDHAWSWVRQPPGRGLEWIGFISYSGITNYNPSLKGRVTISRDNSKNTLYLQMNSLRAEDTAVYYCARSLARTTAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 26 - protein, 447 aa, Artificial Sequence
  VH3-IgG1-F939
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHVTQKSLSLSP

SEQ ID NO: 27 - protein, 447 aa, Artificial Sequence
  VH3(High_pI)-F939
QVQLQESGPGLVKPSQTLSLTCAVSGHSISHDHAWSWVRQPPGRGLEWIGFISYSGITNYNPSLKGRVTISRDNSKNTLYLQMNSLRAEDTAVYYCARSLARTTAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHVTQKSLSLSP

SEQ ID NO: 28 - protein, 447 aa, Artificial Sequence
  VH3-IgG1-F1180
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAYPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSP

SEQ ID NO: 29 - protein, 447 aa, Artificial Sequence
  VH3(High_pI)-F1180
QVQLQESGPGLVKPSQTLSLTCAVSGHSISHDHAWSWVRQPPGRGLEWIGFISYSGITNYNPSLKGRVTISRDNSKNTLYLQMNSLRAEDTAVYYCARSLARTTAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAYPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSP

SEQ ID NO: 30 - protein, 447 aa, Artificial Sequence
  VH3-IgG1-F11
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSP

SEQ ID NO: 31 - protein, 447 aa, Artificial Sequence
  VH3(High_pI)-F11
QVQLQESGPGLVKPSQTLSLTCAVSGHSISHDHAWSWVRQPPGRGLEWIGFISYSGITNYNPSLKGRVTISRDNSKNTLYLQMNSLRAEDTAVYYCARSLARTTAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSP

SEQ ID NO: 32 - protein, 214 aa, Artificial Sequence
  VL3-CK
DIQMTQSPSSLSASVGDSVTITCQASTDISSHLNWYQQKPGKAPELLIYYGSHLLSGVPSRFSGSGSGTDFTFTISSLEAEDAATYYCGQGNRLPYTFGQGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 214 aa, Artificial Sequence
  VL3(High_pI)-CK
DIQMTQSPSSLSASVGDRVTITCRASTDISSHLNWYQQKPGKAPKLLIYYGSHLLSGVPSRFSGSGSGTDFTFTISSLQPEDIATYYCGQGNRLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 447 aa, Artificial Sequence
  H54
QVQLQESGPGLVKPSETLSLTCAVSGYSISDDQAWSWVRQPPGEGLEWIGYISYSGITNYNPSLKGRVTISRDTSKNQFSLKLSSVTAADTAAYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 35 - protein, 214 aa, Artificial Sequence
  L28
DIQMTQSPSSLSASVGDSVTITCQASQDISSYLNWYQQKPGKAPELLIYYGSELHSGVPSRFSGSGSGTDFTFTISSLEAEDAATYYCQQGNSLPYTFGQGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 447 aa, Artificial Sequence
  H(WT)
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 37 - protein, 214 aa, Artificial Sequence [sequence omitted]

SEQ ID NO: 38 - protein, 447 aa, Artificial Sequence
  Ab1H
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 39 - protein, 217 aa, Artificial Sequence
  Ab1L
DIQMTQSPSSVSASVGDRVTITCQASESIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 444 aa, Artificial Sequence
  Ab2H
QSVEESGGRLVTPGTPLTLTCTVSGFSLSSFNMDWVRQAPGEGLEWIGAVSTGGSAYYAKWAKGRFTISKTSTAVDLKITSPTTEDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 41 - protein, 218 aa, Artificial Sequence
  Ab2L
AIEMTQTPFSVSAAVGGTVTINCQASENIYSSLAWYQQKPGQPPKLLIYYASNLASGVSSRFKGSGSGTDFTLTISDLECADAATYYCQSYYFISSTDFNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 447 aa, Artificial Sequence
  Ab3H
QSLEESGGDLVKPGASLTLTCTTSVFDLSSYYWICWVRQAPGKGLEWIACVYATSGSTDYATWAKGRLTISKASSTTVTLQMTSLTAADTATYFCARGGIYGGDGFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 43 - protein, 217 aa, Artificial Sequence
  Ab3L
AFELTQTPASVEAAVGGTVTINCQASESISNWLAWYQQKPGQPPKLLIYRASTLTSGVPSRFKGSGSGTEFTLTISDLECADAATYYCQSYDPSIIDGFAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - protein, 32 aa, Artificial Sequence
  hGPC3-derived peptide
VDDAPGNSQQATPKDNEISTFHNLGNVHSPLK

SEQ ID NO: 45 - skipped

SEQ ID NO: 46 - protein, 447 aa, Artificial Sequence
  VH3-IgG1m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 47 - protein, 447 aa, Artificial Sequence
  VH3-YTE
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 48 - protein, 447 aa, Artificial Sequence
  VH3-LS
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSP

SEQ ID NO: 49 - protein, 447 aa, Artificial Sequence
  VH3-N434H
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHHHYTQKSLSLSP

SEQ ID NO: 50 - protein, 447 aa, Artificial Sequence
  VH3-F1847m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 51 - protein, 447 aa, Artificial Sequence
  VH3-F1848m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHVTRKELSLSP

SEQ ID NO: 52 - protein, 447 aa, Artificial Sequence
  VH3-F1886m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 53 - protein, 447 aa, Artificial Sequence
  VH3-F1889m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHVTRKELSLSP

SEQ ID NO: 54 - protein, 447 aa, Artificial Sequence
  VH3-F1927m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 55 - protein, 447 aa, Artificial Sequence
  VH3-F1168m
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 56 - protein, 447 aa, Artificial Sequence
  OHBH-IgG1
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 57 - protein, 218 aa, Artificial Sequence
  OHBL-CK
DIQMTQSPSSLSASVGDRVTITCQASENIYSSLAWYQQKPGQAPRLLIYYASNLASGVPSRFSGSGSGTDFTLTISSLQPEDVATYYCQSYYFISSTDFNAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 447 aa, Artificial Sequence
  OHBH-LS
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSP

SEQ ID NO: 59 - protein, 447 aa, Artificial Sequence
  OHBH-N434A
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTQKSLSLSP

SEQ ID NO: 60 - protein, 447 aa, Artificial Sequence
  OHBH-F1847m
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 61 - protein, 447 aa, Artificial Sequence
  OHBH-F1848m
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHVTRKELSLSP

SEQ ID NO: 62 - protein, 447 aa, Artificial Sequence
  OHBH-F1886m
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 63 - protein, 447 aa, Artificial Sequence
  OHBH-F1889m
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHVTRKELSLSP

SEQ ID NO: 64 - protein, 447 aa, Artificial Sequence
  OHBH-F1927m
QVTLKESGGRLVKPTETLTLTCTVSGFSLSSFNMDWVRQPPGKGLEWIGAVSTGGSAYYAKWAKGRFTISKDTSKNQVVLTITNMDPVDTATYFCARVDSSGWGYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 65 - protein, 447 aa, Artificial Sequence
  VH3-F1718
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHVTRKELSLSP

SEQ ID NO: 66 - protein, 77 aa, Artificial Sequence
  IL8 molecule
AVLPRSAKELRCQCIKTYSKPFHPKFIKELRVIESGPHCANTEIIVKLSDGRELCLDPKENWVQRVVEKFLKRAENS

SEQ ID NO: 67 - protein, 5 aa, Artificial Sequence
  HVR-H1of WS4
DYYLS

SEQ ID NO: 68 - protein, 19 aa, Artificial Sequence
  HVR-H2 of WS4
LIRNKANGYTREYSASVKG

SEQ ID NO: 69 - protein, 11 aa, Artificial Sequence
  HVR-H3 of WS4
ENYRYDVELAY

SEQ ID NO: 70 - protein, 11 aa, Artificial Sequence
  HVR-L1 of WS4
RASEIIYSYLA

SEQ ID NO: 71 - protein, 7 aa, Artificial Sequence
  HVR-L2 of WS4
NAKTLAD

SEQ ID NO: 72 - protein, 9 aa, Artificial Sequence
  HVR-L3 of WS4
QHHFGFPRT

SEQ ID NO: 73 - protein, 19 aa, Artificial Sequence
  HVR-H2 of H1009
LIRNKDNYHTPEYSASVKG

SEQ ID NO: 74 - protein, 11 aa, Artificial Sequence
  HVR-H3 of H1009
ENHRYDVELAY

SEQ ID NO: 75 - protein, 7 aa, Artificial Sequence
  HVR-L2 of L395
KAKTHAD

SEQ ID NO: 76 - protein, 9 aa, Artificial Sequence
  HVR-L3 of L395
KHHFGFPRT

SEQ ID NO: 77 - protein, 122 aa, Artificial Sequence
  Heavy chain variable region of Hr9
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENYRYDVELAYWGQGTLVTVSS

SEQ ID NO: 78 - protein, 122 aa, Artificial Sequence
  Heavy chain variable region of H1009
QVQLVESGGGLVQPGGSLRLSCAASGFTFSDYYLSWVRQAPGKGLEWVGLIRNKDNYHTPEYSASVKGRFTISRDDSKNSLYLTMSDLKTEDTAVYYCARENHRYDVELAYWGQGTLVTVSS

SEQ ID NO: 79 - protein, 107 aa, Artificial Sequence
  Light chain variable region of L395
DIQMTQSPSSLSASVGDRVTITCRASEIIYSYLAWYQQKPGKAPKLLIYKAKTHADGVPSRFSGSGSGTDFTFTISSLQPEDIATYYCKHHFGFPRTFGQGTKVEIK

SEQ ID NO: 80 - protein, 450 aa, Artificial Sequence
  H1009-F1974m
QVQLVESGGGLVQPGGSLRLSCAASGFTFSDYYLSWVRQAPGKGLEWVGLIRNKDNYHTPEYSASVKGRFTISRDDSKNSLYLTMSDLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 81 - protein, 450 aa, Artificial Sequence
  H1009-F1886s
QVQLVESGGGLVQPGGSLRLSCAASGFTFSDYYLSWVRQAPGKGLEWVGLIRNKDNYHTPEYSASVKGRFTISRDDSKNSLYLTMSDLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRRGPKVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 82 - protein, 214 aa, Artificial Sequence
  L395-k0MT
DIQMTQSPSSLSASVGDRVTITCRASEIIYSYLAWYQQKPGKAPKLLIYKAKTHADGVPSRFSGSGSGTDFTFTISSLQPEDIATYYCKHHFGFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 450 aa, Artificial Sequence
  hWS4H-IgG1
EVQLLESGGGLVQPGGSLRLSCAASGFTFSDYYLSWVRQAPGKGLEWVGLIRNKANGYTREYSASVKGRFTISREDSKNTLYLQMSSLKTEDLAVYYCARENYRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 84 - protein, 214 aa, Artificial Sequence
  hWS4L-k0MT
DIQMTQSPSSLSASVGDRVTITCRASEIIYSYLAWYQQKPGKAPKLLIYNAKTLADGVPSRFSGSGSGTDFTFTISSLQPEDIATYYCQHHFGFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 450 aa, Artificial Sequence
  Hr9-IgG1
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENYRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 86 - protein, 450 aa, Artificial Sequence
  H89-IgG1
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 87 - protein, 214 aa, Artificial Sequence
  L63-k0MT
DIQMTQSPSSLSASVGDRVTITCRASEIIYSYLAWYQQKPGKAPKLLIYHAKTHADGVPSRFSGSGSGTDFTFTISSLQPEDIATYYCQHHFGFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 214 aa, Artificial Sequence
  L118-k0MT
DIQMTQSPSSLSASVGDRVTITCRASEIIYSYLAWYQQKPGKAPKLLIYHAKTHADGVPSRFSGSGSGTDFTFTISSLQPEDIATYYCKHHFGFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 450 aa, Artificial Sequence
  H998-IgG1
QVQLVESGGGLVQPGGSLRLSCAASGFTFSDYYLSWVRQAPGKGLEWVGLIRNKANGYLREYSASVKGRFTISRDDSKNSLYLTMSSLKTEDTAVYYCARENYRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 90 - protein, 450 aa, Artificial Sequence
  H553-IgG1
QVQLVESGGGLVQPGGSLRLSCAASGFTFSDYYLSWVRQAPGKGLEWVGLIRNKANGHTPEYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 91 - protein, 450 aa, Artificial Sequence
  H1004-IgG1m
QVQLVESGGGLVQPGGSLRLSCAASGFTFSDYYLSWVRQAPGKGLEWVGLIRNKDNGYTPEYSASVKGRFTISRDDSKNSLYLTMSDLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 92 - protein, 450 aa, Artificial Sequence
  H1009-IgG1m
QVQLVESGGGLVQPGGSLRLSCAASGFTFSDYYLSWVRQAPGKGLEWVGLIRNKDNYHTPEYSASVKGRFTISRDDSKNSLYLTMSDLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 93 - protein, 450 aa, Artificial Sequence
  1009-F1942m
QVQLVESGGGLVQPGGSLRLSCAASGFTFSDYYLSWVRQAPGKGLEWVGLIRNKDNYHTPEYSASVKGRFTISRDDSKNSLYLTMSDLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRRGPKVFLFPPKPKDTLMADRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 94 - protein, 450 aa, Artificial Sequence
  H89-IgG1m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 95 - protein, 450 aa, Artificial Sequence
  H89-F1168m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 96 - protein, 450 aa, Artificial Sequence
  H89-F1847m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 97 - protein, 450 aa, Artificial Sequence
  H89-F1848m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHVTRKELSLSP

SEQ ID NO: 98 - protein, 450 aa, Artificial Sequence
  H89-F1886m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 99 - protein, 450 aa, Artificial Sequence
  H89-F1889m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHVTRKELSLSP

SEQ ID NO: 100 - protein, 450 aa, Artificial Sequence
  H89-F1927m
QVQLVESGGGLVQPGGSLRLSCAASGFTFSDYYLSWVRQAPGKGLEWVGLIRNKANGYTREYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 101 - protein, 450 aa, Artificial Sequence
  H496-IgG1
QVQLVESGGGLVQPGGSLRLSCAASGFTFSDYYLSWVRQAPGKGLEWVGLIRNKANGYTPEYSASVKGRFTISRDDSKNSLYLQMSSLKTEDTAVYYCARENHRYDVELAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 102 - protein, 5 aa, Artificial Sequence
  HVR-H1
SYGML

SEQ ID NO: 103 - protein, 17 aa, Artificial Sequence
  HVR-H2
DISYDGSNKYYADSVKG

SEQ ID NO: 104 - protein, 8 aa, Artificial Sequence
  HVR-H3
DRIAVADY

SEQ ID NO: 105 - protein, 12 aa, Artificial Sequence
  HVR-L1
RASQSVSSSYLA

SEQ ID NO: 106 - protein, 7 aa, Artificial Sequence
  HVR-L2
GASSRAT

SEQ ID NO: 107 - protein, 8 aa, Artificial Sequence
  HVR-L3
QQYGSSFT

SEQ ID NO: 108 - protein, 5 aa, Artificial Sequence
  HVR-H1
NYGMH

SEQ ID NO: 109 - protein, 17 aa, Artificial Sequence
  HVR-H2
VIYFEGSNKYNADSVKG

SEQ ID NO: 110 - protein, 9 aa, Artificial Sequence
  HVR-H3
SPYGDYLDY

SEQ ID NO: 111 - protein, 12 aa, Artificial Sequence
  HVR-L1
RASQTIDYNYLH

SEQ ID NO: 112 - protein, 7 aa, Artificial Sequence
  HVR-L2
GTFIRAT

SEQ ID NO: 113 - protein, 9 aa, Artificial Sequence
  HVR-L3
QQFGRSPLT

SEQ ID NO: 114 - protein, 5 aa, Artificial Sequence
  HVR-H1
SYGML

SEQ ID NO: 115 - protein, 17 aa, Artificial Sequence
  HVR-H2
DISYDGSNKYYADSVKG

SEQ ID NO: 116 - protein, 8 aa, Artificial Sequence
  HVR-H3
DRIAVADY

SEQ ID NO: 117 - protein, 12 aa, Artificial Sequence
  HVR-L1
RASQSVSSSFLA

SEQ ID NO: 118 - protein, 7 aa, Artificial Sequence
  HVR-L2
GASSRAT

SEQ ID NO: 119 - protein, 8 aa, Artificial Sequence
  HVR-L3
QQYDSSFT

SEQ ID NO: 120 - protein, 5 aa, Artificial Sequence
  HVR-H1
GYYWT

SEQ ID NO: 121 - protein, 16 aa, Artificial Sequence
  HVR-H2
EVIHHGSTNYSPSLKS

SEQ ID NO: 122 - protein, 9 aa, Artificial Sequence
  HVR-H3
GGAAAALDS

SEQ ID NO: 123 - protein, 17 aa, Artificial Sequence
  HVR-L1
KSSQSVLFSSNNRKYLA

SEQ ID NO: 124 - protein, 7 aa, Artificial Sequence
  HVR-L2
WASTRES

SEQ ID NO: 125 - protein, 9 aa, Artificial Sequence
  HVR-L3
QQYYSTPFT

SEQ ID NO: 126 - protein, 5 aa, Artificial Sequence
  HVR-H1
SYWMH

SEQ ID NO: 127 - protein, 17 aa, Artificial Sequence
  HVR-H2
EIDPSDSNTNYNQKFKG

SEQ ID NO: 128 - protein, 7 aa, Artificial Sequence
  HVR-H3
ELLHAVY

SEQ ID NO: 129 - protein, 11 aa, Artificial Sequence
  HVR-L1
TASQDIHKYIS

SEQ ID NO: 130 - protein, 6 aa, Artificial Sequence
  HVR-L2
TSTLQP

SEQ ID NO: 131 - protein, 8 aa, Artificial Sequence
  HVR-L3
LQYDNLWT

SEQ ID NO: 132 - protein, 5 aa, Artificial Sequence
  HVR-H1
NYWIV

SEQ ID NO: 133 - protein, 17 aa, Artificial Sequence
  HVR-H2
DLYSGGGYTFYSENFKG

SEQ ID NO: 134 - protein, 10 aa, Artificial Sequence
  HVR-H3
SGYDRTWFAH

SEQ ID NO: 135 - protein, 11 aa, Artificial Sequence
  HVR-L1
QASQDIESYLS

SEQ ID NO: 136 - protein, 7 aa, Artificial Sequence
  HVR-L2
YATRLAD

SEQ ID NO: 137 - protein, 9 aa, Artificial Sequence
  HVR-L3
LQHGESPPT

SEQ ID NO: 138 - protein, 5 aa, Artificial Sequence
  HVR-H1
HYGMY

SEQ ID NO: 139 - protein, 17 aa, Artificial Sequence
  HVR-H2
VIWYDGSYEYNADSVKG

SEQ ID NO: 140 - protein, 8 aa, Artificial Sequence
  HVR-H3
DRVGLFDY

SEQ ID NO: 141 - protein, 12 aa, Artificial Sequence
  HVR-L1
RASQSISSSYLA

SEQ ID NO: 142 - protein, 7 aa, Artificial Sequence
  HVR-L2
GPSSRAT

SEQ ID NO: 143 - protein, 8 aa, Artificial Sequence
  HVR-L3
QQYAGSLT

SEQ ID NO: 144 - protein, 447 aa, Artificial Sequence
  H003
QVQLVESGGGLVQPGGSLRLSCAASGFTLSNRDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 145 - protein, 447 aa, Artificial Sequence
  H005
QVQLVESGGGLVQPGGSLRLSCAASGFTLSNHDMTWVRQARGKRLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 146 - protein, 447 aa, Artificial Sequence
  H010
QVQLVESGGGLVQPGGSLRLSCAASGFTLSNHDMTWVRQAPGKGLEYVSIINTYGNHWYANWASGRFTISRDNSKNRVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 147 - protein, 447 aa, Artificial Sequence
  H012
QVQLVESGGGLVQPGGSLRLSCAASGFTLSNHDMTWVRQAPGKGLEYVSIINTYGNHWYANWASGRFTISRDNSKNTVYLQINRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 148 - protein, 447 aa, Artificial Sequence
  H013
QVQLVESGGGLVQPGGSLRLSCAASGFTLSNHDMTWVRQAPGKGLEYVSIINTYGNHWYANWASGRFTISRDNSKNTVYLQIGRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 149 - protein, 447 aa, Artificial Sequence
  H014
QVQLVESGGGLVQPGGSLRLSCAASGFTLSNHDMTWVRQAPGKGLEYVSIINTYGNHWYANWASGRFTISRDNSKNTVYLQISRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 150 - protein, 447 aa, Artificial Sequence
  H016
QVQLVESGGGLVQPGGSLRLSCAASGFTLSNHDMTWVRQAPGKGLEYVSIINTYGNHWYANWASGRFTISRDNSKNTVYLQIDSLRAGDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 151 - protein, 447 aa, Artificial Sequence
  H018
QVQLVESGGGLVQPGGSLRLSCAASGFTLSNHDMTWVRQAPGKGLEYVSIINTYGNHWYANWASGRFTISRDNSKNTVYLQIDSLRAEDTATYYCKRETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 152 - protein, 447 aa, Artificial Sequence
  H026
QVQLVESGGGLVQPGGSLRLSCAASGFTLSNHDMTWVRQARGKRLEYVSIINTYGNHWYANWASGRFTISRDNSKNRVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 153 - protein, 447 aa, Artificial Sequence
  H027
QVQLVESGGGLVQPGGSLRLSCAASGFTLSNHDMTWVRQAPGKGLEYVSIINTYGNHWYANWASGRFTISRDNSKNRVYLQINRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 154 - protein, 447 aa, Artificial Sequence
  H028
QVQLVESGGGLVQPGGSLRLSCAASGFTLSNHDMTWVRQAPGKGLEYVSIINTYGNHWYANWASGRFTISRDNSKNRVYLQIGRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 155 - protein, 447 aa, Artificial Sequence
  H029
QVQLVESGGGLVQPGGSLRLSCAASGFTLSNHDMTWVRQAPGKGLEYVSIINTYGNHWYANWASGRFTISRDNSKNRVYLQISRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 156 - protein, 447 aa, Artificial Sequence
  H030
QVQLVESGGGLVQPGGSLRLSCAASGFTLSNHDMTWVRQAPGKGLEYVSIINTYGNHWYANWASGRFTISRDNSKNRVYLQIDSLRAGDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 157 - protein, 447 aa, Artificial Sequence
  H031
QVQLVESGGGLVQPGGSLRLSCAASGFTLSNHDMTWVRQAPGKGLEYVSIINTYGNHWYANWASGRFTISRDNSKNRVYLQIDSLRAEDTATYYCKRETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 158 - protein, 447 aa, Artificial Sequence
  H032
QVQLVESGGGLVQPGGSLRLSCAASGFTLSNHDMTWVRQAPGKGLEYVSIINTYGNHWYANWASGRFTISRDNSKNTVYLQIGRLRAGDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 447 aa, Artificial Sequence
  H034
QVQLVESGGGLVKPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 160 - protein, 447 aa, Artificial Sequence
  H035
QVQLVESGGGLVQPRGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 161 - protein, 447 aa, Artificial Sequence
  H039
QVQLVESGGGLVQPGGSLRLSCAASGFTLSNHDMTWVRQAPGKGLEYVSIINTYGNHWYANWAKGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 162 - protein, 447 aa, Artificial Sequence
  H041
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 163 - protein, 447 aa, Artificial Sequence
  H045
QVQLVESGGGLVQPGGSLRLSCAASGFTLSNHDMTWVRQAPGKGLEYVSIINTYGNHWYANWASGRFTISRDNSKNTVYLQIDRLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 164 - protein, 217 aa, Artificial Sequence
  L001
DIQMTQSPSSVSASVKDRVTITCQASESIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 217 aa, Artificial Sequence
  L002
DIQMTQSPSSVSASVGDRVTITCRASQSIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 217 aa, Artificial Sequence
  L003
DIQMTQSPSSVSASVGDRVTITCRASRSIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 217 aa, Artificial Sequence
  L004
DIQMTQSPSSVSASVGDRVTITCKASKSIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 217 aa, Artificial Sequence
  L005
DIQMTQSPSSVSASVGDRVTITCQKKESIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 217 aa, Artificial Sequence
  L006
DIQMTQSPSSVSASVGDRVTITCQRRESIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 217 aa, Artificial Sequence
  L007
DIQMTQSPSSVSASVGDRVTITCQASESIYSGLAWYRQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 217 aa, Artificial Sequence
  L008
DIQMTQSPSSVSASVGDRVTITCQASESIYSGLAWYQQKPRKPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 217 aa, Artificial Sequence
  L009
DIQMTQSPSSVSASVGDRVTITCQASESIYSGLAWYQQKPGQPPKRLIKDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - protein, 217 aa, Artificial Sequence
  L010
DIQMTQSPSSVSASVGDRVTITCQASESIYSGLAWYQQKPGQPPKLLIYDHRTLARGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 217 aa, Artificial Sequence
  L011
DIQMTQSPSSVSASVGDRVTITCQASESIYSGLAWYQQKPGQPPKLLIYDHKTLAKGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 175 - protein, 217 aa, Artificial Sequence
  L012
DIQMTQSPSSVSASVGDRVTITCQASESIYSGLAWYQQKPGQPPKLLIYDHSTLASGVPSRFSGRGSGREYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 217 aa, Artificial Sequence
  L013
DIQMTQSPSSVSASVGDRVTITCQASESIYSGLAWYQQKPGQPPKLLIYDHSTLASGVPSRFSGSGSGTEYALKISRLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 177 - protein, 217 aa, Artificial Sequence
  L014
DIQMTQSPSSVSASVGDRVTITCQASESIYSGLAWYQQKPGQPPKLLIYDHSTLASGVPSRFSGSGSGTEYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 217 aa, Artificial Sequence
  L015
DIQMTQSPSSVSASVKDRVTITCRASRSIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 179 - protein, 217 aa, Artificial Sequence
  L016
DIQMTQSPSSVSASVGDRVTITCRASRSIYSGLAWYRQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 217 aa, Artificial Sequence
  L017
DIQMTQSPSSVSASVGDRVTITCRASRSIYSGLAWYQQKPRKPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - protein, 217 aa, Artificial Sequence
  L018
DIQMTQSPSSVSASVGDRVTITCRASRSIYSGLAWYQQKPGQPPKRLIKDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 217 aa, Artificial Sequence
  L019
DIQMTQSPSSVSASVGDRVTITCRASRSIYSGLAWYQQKPGQPPKLLIYDHRTLARGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 183 - protein, 217 aa, Artificial Sequence
  L020
DIQMTQSPSSVSASVGDRVTITCRASRSIYSGLAWYQQKPGQPPKLLIYDHKTLAKGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 217 aa, Artificial Sequence
  L021
DIQMTQSPSSVSASVGDRVTITCRASRSIYSGLAWYQQKPGQPPKLLIYDHSTLASGVPSRFSGRGSGREYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 217 aa, Artificial Sequence
  L022
DIQMTQSPSSVSASVGDRVTITCRASRSIYSGLAWYQQKPGQPPKLLIYDHSTLASGVPSRFSGSGSGTEYALKISRLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 217 aa, Artificial Sequence
  L023
DIQMTQSPSSVSASVGDRVTITCRASRSIYSGLAWYQQKPGQPPKLLIYDHSTLASGVPSRFSGSGSGTEYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 187 - protein, 217 aa, Artificial Sequence
  L024
DIQMTQSPSSVSASVKDRVTITCQRRESIYSGLAWYQQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 188 - protein, 217 aa, Artificial Sequence
  L025
DIQMTQSPSSVSASVGDRVTITCQRRESIYSGLAWYRQKPGQPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - protein, 217 aa, Artificial Sequence
  L026
DIQMTQSPSSVSASVGDRVTITCQRRESIYSGLAWYQQKPRKPPKLLIYDHSTLASGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - protein, 217 aa, Artificial Sequence
  L028
DIQMTQSPSSVSASVGDRVTITCQRRESIYSGLAWYQQKPGQPPKLLIYDHRTLARGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 217 aa, Artificial Sequence
  L029
DIQMTQSPSSVSASVGDRVTITCQRRESIYSGLAWYQQKPGQPPKLLIYDHKTLAKGVPSRFSGSGSGTEYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - protein, 217 aa, Artificial Sequence
  L030
DIQMTQSPSSVSASVGDRVTITCQRRESIYSGLAWYQQKPGQPPKLLIYDHSTLASGVPSRFSGRGSGREYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 193 - protein, 217 aa, Artificial Sequence
  L032
DIQMTQSPSSVSASVGDRVTITCQRRESIYSGLAWYQQKPGQPPKLLIYDHSTLASGVPSRFSGSGSGTEYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 194 - protein, 217 aa, Artificial Sequence
  L033
DIQMTQSPSSVSASVGDRVTITCRASRSIYSGLAWYQQKPRKPPKLLIYDHSTLASGVPSRFSGRGSGREYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 195 - protein, 217 aa, Artificial Sequence
  L034
DIQMTQSPSSVSASVGDRVTITCRASRSIYSGLAWYQQKPGQPPKLLIYDHRTLARGVPSRFSGRGSGREYALTISSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 217 aa, Artificial Sequence
  L035
DIQMTQSPSSVSASVGDRVTITCRASRSIYSGLAWYQQKPGQPPKLLIYDHSTLASGVPSRFSGRGSGREYALKISRLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 217 aa, Artificial Sequence
  L036
DIQMTQSPSSVSASVGDRVTITCRASRSIYSGLAWYQQKPGQPPKLLIYDHSTLASGVPSRFSGRGSGREYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 198 - protein, 217 aa, Artificial Sequence
  L037
DIQMTQSPSSVSASVGDRVTITCRASRSIYSGLAWYQQKPRKPPKLLIYDHSTLASGVPSRFSGSGSGTEYALKISRLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 217 aa, Artificial Sequence
  L038
DIQMTQSPSSVSASVGDRVTITCRASRSIYSGLAWYQQKPGQPPKLLIYDHRTLARGVPSRFSGSGSGTEYALKISRLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 217 aa, Artificial Sequence
  L039
DIQMTQSPSSVSASVGDRVTITCRASRSIYSGLAWYQQKPGQPPKLLIYDHSTLASGVPSRFSGSGSGTEYALKIRRLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 201 - protein, 217 aa, Artificial Sequence
  L040
DIQMTQSPSSVSASVGDRVTITCRASRSIYSGLAWYQQKPRKPPKLLIYDHSTLASGVPSRFSGSGSGTEYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 202 - protein, 217 aa, Artificial Sequence
  L041
DIQMTQSPSSVSASVGDRVTITCRASRSIYSGLAWYQQKPGQPPKLLIYDHRTLARGVPSRFSGSGSGTEYALTIRSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 203 - protein, 217 aa, Artificial Sequence
  L061
DIQMTQSPSSVSASVGDRVTITCQASESIYSGLAWYQQKPGKPPKLLIYDHSTLASGVPSRFSGSGSGTEYALTIRSLQPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 217 aa, Artificial Sequence
  L062
DIQMTQSPSSVSASVGDRVTITCQASESIYSGLAWYQQKPGQPPKLLIYDHSTLASGVPSRFSGRGSGTEYALTISSLKPEDFATYYCQHADYAHHSDNVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205-206 - skipped (2 entries)

SEQ ID NO: 207 - protein, 1676 aa, Artificial Sequence
  Recombinant human C5
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 208 - protein, 1676 aa, Artificial Sequence
  cynomolgus monkey C5
MGLLGILCFLIFLGKTWGQEQTYVISAPKIFRVGASENIVIQVYGYTEAFDATISIKSYPDKKFSYSSGHVHLSSENKFQNSAVLTIQPKQLPGGQNQVSYVYLEVVSKHFSKSKKIPITYDNGFLFIHTDKPVYTPDQSVKVRVYSLNDDLKPAKRETVLTFIDPEGSEIDMVEEIDHIGIISFPDFKIPSNPRYGMWTIQAKYKEDFSTTGTAFFEVKEYVLPHFSVSVEPESNFIGYKNFKNFEITIKARYFYNKVVTEADVYITFGIREDLKDDQKEMMQTAMQNTMLINGIAEVTFDSETAVKELSYYSLEDLNNKYLYIAVTVIESTGGFSEEAEIPGIKYVLSPYKLNLVATPLFLKPGIPYSIKVQVKDALDQLVGGVPVTLNAQTIDVNQETSDLEPRKSVTRVDDGVASFVVNLPSGVTVLEFNVKTDAPDLPDENQAREGYRAIAYSSLSQSYLYIDWTDNHKALLVGEYLNIIVTPKSPYIDKITHYNYLILSKGKIIHFGTREKLSDASYQSINIPVTQNMVPSSRLLVYYIVTGEQTAELVSDSVWLNIEEKCGNQLQVHLSPDADTYSPGQTVSLNMVTGMDSWVALTAVDSAVYGVQRRAKKPLERVFQFLEKSDLGCGAGGGLNNANVFHLAGLTFLTNANADDSQENDEPCKEIIRPRRMLQEKIEEIAAKYKHLVVKKCCYDGVRINHDETCEQRAARISVGPRCVKAFTECCVVASQLRANNSHKDLQLGRLHMKTLLPVSKPEIRSYFPESWLWEVHLVPRRKQLQFALPDSVTTWEIQGVGISNSGICVADTIKAKVFKDVFLEMNIPYSVVRGEQVQLKGTVYNYRTSGMQFCVKMSAVEGICTSESPVIDHQGTKSSKCVRQKVEGSSNHLVTFTVLPLEIGLQNINFSLETSFGKEILVKSLRVVPEGVKRESYSGITLDPRGIYGTISRRKEFPYRIPLDLVPKTEIKRILSVKGLLVGEILSAVLSREGINILTHLPKGSAEAELMSVVPVFYVFHYLETGNHWNIFHSDPLIEKRNLEKKLKEGMVSIMSYRNADYSYSVWKGGSASTWLTAFALRVLGQVHKYVEQNQNSICNSLLWLVENYQLDNGSFKENSQYQPIKLQGTLPVEARENSLYLTAFTVIGIRKAFDICPLVKINTALIKADTFLLENTLPAQSTFTLAISAYALSLGDKTHPQFRSIVSALKREALVKGNPPIYRFWKDSLQHKDSSVPNTGTARMVETTAYALLTSLNLKDINYVNPIIKWLSEEQRYGGGFYSTQDTINAIEGLTEYSLLVKQLRLNMDIDVAYKHKGPLHNYKMTDKNFLGRPVEVLLNDDLVVSTGFGSGLATVHVTTVVHKTSTSEEVCSFYLKIDTQDIEASHYRGYGNSDYKRIVACASYKPSKEESSSGSSHAVMDISLPTGINANEEDLKALVEGVDQLFTDYQIKDGHVILQLNSIPSSDFLCVRFRIFELFEVGFLSPATFTVYEYHRPDKQCTMFYSTSNIKIQKVCEGATCKCIEADCGQMQKELDLTISAETRKQTACNPEIAYAYKVIITSITTENVFVKYKATLLDIYKTGEAVAEKDSEITFIKKVTCTNAELVKGRQYLIMGKEALQIKYNFTFRYIYPLDSLTWIEYWPRDTTCSSCQAFLANLDEFAEDIFLNGC

SEQ ID NO: 209 - protein, 126 aa, Artificial Sequence
  CFP0008H
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVHIKYMIQYYYGAMDVWGQGTTVTVSS

SEQ ID NO: 210 - protein, 107 aa, Artificial Sequence
  CFP0008L
DIQMTQSPSSLSASVGDRVTITCRASQSIEDDLAWYQQKPGKAPKLLIYEASSLQSGVPSRFSGSGSGTDFTLTISSLQPEDFATYYCQQHDGSPLTFGQGTKVEIK

SEQ ID NO: 211 - protein, 127 aa, Artificial Sequence
  CFP0011H
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDMSEFLGWSNYYSYPMDVWGQGTTVTVSS

SEQ ID NO: 212 - protein, 107 aa, Artificial Sequence
  CFP0011L
DIQMTQSPSSLSASVGDRVTITCRASQSIEDDLAWYQQKPGKAPKLLIYHASSLQSGVPSRFSGSGSGTDFTLTISSLQPEDFATYYCQQSDNSPYTFGQGTKVEIK

SEQ ID NO: 213 - protein, 123 aa, Artificial Sequence
  CFP0015H
QVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARGDQIWYDQWYYFDMWGQGTLVTVSS

SEQ ID NO: 214 - protein, 107 aa, Artificial Sequence
  CFP0015L
DIQMTQSPSSLSASVGDRVTITCRASQSIEDDLAWYQQKPGKAPKLLIYEASNLQSGVPSRFSGSGSGTDFTLTISSLQPEDFATYYCQQYDSSPLTFGQGTKVEIK

SEQ ID NO: 215 - protein, 122 aa, Artificial Sequence
  CFP0016H019
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDPYYSYPWSTFDYWGQGTLVTVSS

SEQ ID NO: 216 - protein, 107 aa, Artificial Sequence
  CFP0016L
DIQMTQSPSSLSASVGDRVTITCRASQSIEDDLAWYQQKPGKAPKLLIYEASTLQSGVPSRFSGSGSGTDFTLTISSLQPEDFATYYCQQSNNLPLTFGQGTKVEIK

SEQ ID NO: 217 - protein, 119 aa, Artificial Sequence
  CFP0017H
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGGWWGGALDYWGQGTLVTVSS

SEQ ID NO: 218 - protein, 107 aa, Artificial Sequence
  CFP0017L
DIQMTQSPSSLSASVGDRVTITCRASQSIEDDLAWYQQKPGKAPKLLIYHASSLQSGVPSRFSGSGSGTDFTLTISSLQPEDFATYYCQQSDSYPLTFGQGTKVEIK

SEQ ID NO: 219 - protein, 119 aa, Artificial Sequence
  CFP0018H
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARQLYGYYELDIWGQGTLVTVSS

SEQ ID NO: 220 - protein, 107 aa, Artificial Sequence
  CFP0018L
DIQMTQSPSSLSASVGDRVTITCRASQSISDDLAWYQQKPGKAPKLLIYEASSLQSGVPSRFSGSGSGTDFTLTISSLQPEDFATYYCQQYNSYPLTFGQGTKVEIK

SEQ ID NO: 221 - protein, 122 aa, Artificial Sequence
  CFP0019H
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARYYVWLGGPTYMDYWGQGTLVTVSS

SEQ ID NO: 222 - protein, 107 aa, Artificial Sequence
  CFP0019L
DIQMTQSPSSLSASVGDRVTITCRASQSIEDDLAWYQQKPGKAPKLLIYHASTLQSGVPSRFSGSGSGTDFTLTISSLQPEDFATYYCQQSDGYPLTFGQGTKVEIK

SEQ ID NO: 223 - protein, 122 aa, Artificial Sequence
  CFP0020H
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARHDPTWYSTGYFDYWGQGTLVTVSS

SEQ ID NO: 224 - protein, 107 aa, Artificial Sequence
  CFP0020L
DIQMTQSPSSLSASVGDRVTITCRASQSISDDLAWYQQKPGKAPKLLIYEASNLQSGVPSRFSGSGSGTDFTLTISSLQPEDFATYYCQQYDSYPYTFGQGTKVEIK

SEQ ID NO: 225 - protein, 122 aa, Artificial Sequence
  CFP0021H
QVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARTGMMYWGIFDVWGQGTLVTVSS

SEQ ID NO: 226 - protein, 107 aa, Artificial Sequence
  CFP0021L
DIQMTQSPSSLSASVGDRVTITCRASQSIEDDLAWYQQKPGKAPKLLIYHASTLQSGVPSRFSGSGSGTDFTLTISSLQPEDFATYYCQQHDSYPLTFGQGTKVEIK

SEQ ID NO: 227 - protein, 328 aa, Artificial Sequence
  G1dP1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 228 - protein, 328 aa, Artificial Sequence
  G1dN1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 229 - protein, 450 aa, Artificial Sequence
  CFP0020H0261-G1dP1_optimized 20 heavy chain
QVQLQESGPGLVKPSETLSLTCAVSGYSISSGYYWGWIRQPPGKGLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 230 - protein, 447 aa, Artificial Sequence
  CFP0018H0012-G1dN1_optimized 18 heavy chain
QVQLVQSGAEVKKPGSSVKVSCKASGGTFSSYSISWVRQAPGQGLEWMGGIIPIFGTANYAQKFQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 231 - protein, 214 aa, Artificial Sequence
  CFP0020L233-k0_optimized 20//18 light chain
DIQMTQSPSSLSASVGDRVTITCRASQSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - protein, 450 aa, Artificial Sequence
  CFP0020H0261-001-G1dP1
QVQLQESGPGLVKPSETLSLTCAVSGYSISSGYYWGWIRQPRGKRLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 233 - protein, 450 aa, Artificial Sequence
  CFP0020H0261-002-G1dP1
QVQLQESGPGLVKPSETLSLTCAVSGYSISSGYYWGWIRQPPGKGLEWIGSIYHSGSTYYNKKLKSRVTISVDTSKNRFSLKLSSVTARDTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 234 - protein, 450 aa, Artificial Sequence
  CFP0020H0261-003-G1dP1
QVQLQESGPGLVKPSETRSLTCAVSGYSISSGYYWGWIRQPPGKGLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 235 - protein, 450 aa, Artificial Sequence
  CFP0020H0261-005-G1dP1
QVQLQESGPGLVKPRETLSLTCAVSGYSISSGYYWGWIRQPPGKGLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 236 - protein, 450 aa, Artificial Sequence
  CFP0020H0261-008-G1dP1
QVQLQESGPGLVKPSETLSLTCAVSGYSISSRYYWGWIRQPPGKGLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 237 - protein, 450 aa, Artificial Sequence
  CFP0020H0261-009-G1dP1
QVQLQESGPGLVKPSETLSLTCAVSGYSISSGYYWGWIRKPPGKGLEWIGSIYHSGSTYYNKKLKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 238 - protein, 450 aa, Artificial Sequence
  CFP0020H0261-013-G1dP1
QVQLQESGPGLVKPSETLSLTCAVSGYSISSGYYWGWIRQPPGKGLEWIGSIYHSGSTYYNKKRKSRVTISVDTSKNQFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 239 - protein, 450 aa, Artificial Sequence
  CFP0020H0261-018-G1dP1
QVQLQESGPGLVKPSETLSLTCAVSGYSISSGYYWGWIRQPPGKGLEWIGSIYHSGSTYYNKKLKSRVTISVDTSKNRFSLKLSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 240 - protein, 450 aa, Artificial Sequence
  CFP0020H0261-019-G1dP1
QVQLQESGPGLVKPSETLSLTCAVSGYSISSGYYWGWIRQPPGKGLEWIGSIYHSGSTYYNKKLKSRVTISVDTSKNQFSLKKSSVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 241 - protein, 450 aa, Artificial Sequence
  CFP0020H0261-020-G1dP1
QVQLQESGPGLVKPSETLSLTCAVSGYSISSGYYWGWIRQPPGKGLEWIGSIYHSGSTYYNKKLKSRVTISVDTSKNQFSLKLNRVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 242 - protein, 450 aa, Artificial Sequence
  CFP0020H0261-021-G1dP1
QVQLQESGPGLVKPSETLSLTCAVSGYSISSGYYWGWIRQPPGKGLEWIGSIYHSGSTYYNKKLKSRVTISVDTSKNQFSLKLGRVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 243 - protein, 450 aa, Artificial Sequence
  CFP0020H0261-022-G1dP1
QVQLQESGPGLVKPSETLSLTCAVSGYSISSGYYWGWIRQPPGKGLEWIGSIYHSGSTYYNKKLKSRVTISVDTSKNQFSLKLSRVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 244 - protein, 450 aa, Artificial Sequence
  CFP0020H0261-023-G1dP1
QVQLQESGPGLVKPSETLSLTCAVSGYSISSGYYWGWIRQPPGKGLEWIGSIYHSGSTYYNKKLKSRVTISVDTSKNQFSLKLSSRTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 245 - protein, 450 aa, Artificial Sequence
  CFP0020H0261-025-G1dP1
QVQLQESGPGLVKPSETLSLTCAVSGYSISSGYYWGWIRQPPGKGLEWIGSIYHSGSTYYNKKLKSRVTISVDTSKNQFSLKLSSVTAAGTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 246 - protein, 450 aa, Artificial Sequence
  CFP0020H0261-026-G1dP1
QVQLQESGPGLVKPSETLSLTCAVSGYSISSGYYWGWIRQPPGKGLEWIGSIYHSGSTYYNKKLKSRVTISVDTSKNQFSLKLSSVTAADTAVYYCKRHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 247 - protein, 450 aa, Artificial Sequence
  CFP0020H0261-032-G1dP1
QVQLQESGPGLVKPSETLSLTCAVSGYSISSGYYWGWIRQPPGKGLEWIGSIYHSGSTYYNKKLKSRVTISVDTSKNQFSLKKSRVTAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 248 - protein, 450 aa, Artificial Sequence
  CFP0020H0261-035-G1dP1
QVQLQESGPGLVKPSETLSLTCAVSGYSISSGYYWGWIRQPPGKGLEWIGSIYHSGSTYYNKKLKSRVTISVDTSKNQFSLKLSRVRAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 249 - protein, 450 aa, Artificial Sequence
  CFP0020H0261-036-G1dP1
QVQLQESGPGLVKPSETLSLTCAVSGYSISSGYYWGWIRQPPGKGLEWIGSIYHSGSTYYNKKLKSRVTISVDTSKNQFSLKLSSVRAADTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 250 - protein, 450 aa, Artificial Sequence
  CFP0020H0261-037-G1dP1
QVQLQESGPGLVKPSETLSLTCAVSGYSISSGYYWGWIRQPPGKGLEWIGSIYHSGSTYYNKKLKSRVTISRDTSKNQFSLKLSSVTAGDTAVYYCARHDPTWYHHGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 251 - protein, 447 aa, Artificial Sequence
  CFP0018H0012-002-G1dN1
QVQLVQSGAEVKKPGSSVKVSCKASGGTFSSYSISWVRQAPGQGLEWMGGIIPIFGTANYAQKFQGRVTITADESTSRAYMELSSLRSGDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 252 - protein, 447 aa, Artificial Sequence
  CFP0018H0012-003-G1dN1
QVQLVQSRAEVKKPGSSVKVSCKASGGTFSSYSISWVRQAPGQGLEWMGGIIPIFGTANYAQKFQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 253 - protein, 447 aa, Artificial Sequence
  CFP0018H0012-005-G1dN1
QVQLVQSGAEVKKPRSSVKVSCKASGGTFSSYSISWVRQAPGQGLEWMGGIIPIFGTANYAQKFQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 254 - protein, 447 aa, Artificial Sequence
  CFP0018H0012-008-G1dN1
QVQLVQSGAEVKKPGSSVKVSCKASGGTFSSRSISWVRQAPGQGLEWMGGIIPIFGTANYAQKFQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 255 - protein, 447 aa, Artificial Sequence
  CFP0018H0012-009-G1dN1
QVQLVQSGAEVKKPGSSVKVSCKASGGTFSSYSISWVRKAPGQGLEWMGGIIPIFGTANYAQKFQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 256 - protein, 447 aa, Artificial Sequence
  CFP0018H0012-013-G1dN1
QVQLVQSGAEVKKPGSSVKVSCKASGGTFSSYSISWVRQAPGQGLEWMGGIIPIFGTANYAQKRQGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 257 - protein, 447 aa, Artificial Sequence
  CFP0018H0012-014-G1dN1
QVQLVQSGAEVKKPGSSVKVSCKASGGTFSSYSISWVRQAPGQGLEWMGGIIPIFGTANYAQKFKGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 258 - protein, 447 aa, Artificial Sequence
  CFP0018H0012-016-G1dN1
QVQLVQSGAEVKKPGSSVKVSCKASGGTFSSYSISWVRQAPGQGLEWMGGIIPIFGTANYAQKRKGRVTITADESTSTAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 259 - protein, 447 aa, Artificial Sequence
  CFP0018H0012-018-G1dN1
QVQLVQSGAEVKKPGSSVKVSCKASGGTFSSYSISWVRQAPGQGLEWMGGIIPIFGTANYAQKFQGRVTITADESTSRAYMELSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 260 - protein, 447 aa, Artificial Sequence
  CFP0018H0012-019-G1dN1
QVQLVQSGAEVKKPGSSVKVSCKASGGTFSSYSISWVRQAPGQGLEWMGGIIPIFGTANYAQKFQGRVTITADESTSTAYMEKSSLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 261 - protein, 447 aa, Artificial Sequence
  CFP0018H0012-020-G1dN1
QVQLVQSGAEVKKPGSSVKVSCKASGGTFSSYSISWVRQAPGQGLEWMGGIIPIFGTANYAQKFQGRVTITADESTSTAYMELNRLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 262 - protein, 447 aa, Artificial Sequence
  CFP0018H0012-021-G1dN1
QVQLVQSGAEVKKPGSSVKVSCKASGGTFSSYSISWVRQAPGQGLEWMGGIIPIFGTANYAQKFQGRVTITADESTSTAYMELGRLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 263 - protein, 447 aa, Artificial Sequence
  CFP0018H0012-022-G1dN1
QVQLVQSGAEVKKPGSSVKVSCKASGGTFSSYSISWVRQAPGQGLEWMGGIIPIFGTANYAQKFQGRVTITADESTSTAYMELSRLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 264 - protein, 447 aa, Artificial Sequence
  CFP0018H0012-023-G1dN1
QVQLVQSGAEVKKPGSSVKVSCKASGGTFSSYSISWVRQAPGQGLEWMGGIIPIFGTANYAQKFQGRVTITADESTSTAYMELSSRRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 265 - protein, 447 aa, Artificial Sequence
  CFP0018H0012-024-G1dN1
QVQLVQSGAEVKKPGSSVKVSCKASGGTFSSYSISWVRQAPGQGLEWMGGIIPIFGTANYAQKFQGRVTITADESTSTAYMELSSLRSGDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 266 - protein, 447 aa, Artificial Sequence
  CFP0018H0012-025-G1dN1
QVQLVQSGAEVKKPGSSVKVSCKASGGTFSSYSISWVRQAPGQGLEWMGGIIPIFGTANYAQKFQGRVTITADESTSTAYMELSSLRSEGTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 267 - protein, 447 aa, Artificial Sequence
  CFP0018H0012-026-G1dN1
QVQLVQSGAEVKKPGSSVKVSCKASGGTFSSYSISWVRQAPGQGLEWMGGIIPIFGTANYAQKFQGRVTITADESTSTAYMELSSLRSEDTAVYYCKRQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 268 - protein, 447 aa, Artificial Sequence
  CFP0018H0012-027-G1dN1
QVQLVQSGAEVKKPGSSVKVSCKASGGTFSSYSISWVRQAPGQGLEWMGGIIPIFGTANYAQKFQGRVTITADESTSTAYMELSSLRSEDTAVYYCARQLYGYYELDIWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 269 - protein, 447 aa, Artificial Sequence
  CFP0018H0012-032-G1dN1
QVQLVQSGAEVKKPGSSVKVSCKASGGTFSSYSISWVRQAPGQGLEWMGGIIPIFGTANYAQKFQGRVTITADESTSTAYMEKSRLRSEDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 270 - protein, 447 aa, Artificial Sequence
  CFP0018H0012-037-G1dN1
QVQLVQSGAEVKKPGSSVKVSCKASGGTFSSYSISWVRQAPGQGLEWMGGIIPIFGTANYAQKFQGRVTITRDESTSTAYMELSSLRSGDTAVYYCARQLYGYYELDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 271 - protein, 214 aa, Artificial Sequence
  CFP0020L233-001-k0
DIQMTQSPSSLSASVKDRVTITCRASQSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 272 - protein, 214 aa, Artificial Sequence
  CFP0020L233-002-k0
DIQMTQSPSSLSASVGDRVTITCRASRSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 273 - protein, 214 aa, Artificial Sequence
  CFP0020L233-003-k0
DIQMTQSPSSLSASVGDRVTITCRRRQSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 214 aa, Artificial Sequence
  CFP0020L233-004-k0
DIQMTQSPSSLSASVGDRVTITCRASQSIHNDLAWYQQKPGKAPKLLIYEAKELQKGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 214 aa, Artificial Sequence
  CFP0020L233-005-k0
DIQMTQSPSSLSASVGDRVTITCRASQSIHNDLAWYQQKPGKAPKLLIYEASELQSGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 214 aa, Artificial Sequence
  CFP0020L233-006-k0
DIQMTQSPSSLSASVGDRVTITCRASQSIHNDLAWYQQKPGKAPKLLIYEASELQSGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 214 aa, Artificial Sequence
  CFP0020L233-007-k0
DIQMTQSPSSLSASVGDRVTITCRASKSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 214 aa, Artificial Sequence
  CFP0020L233-008-k0
DIQMTQSPSSLSASVGDRVTITCRKKQSIHNDLAWYQQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 214 aa, Artificial Sequence
  CFP0020L233-009-k0
DIQMTQSPSSLSASVGDRVTITCRASQSIHNDLAWYRQKPGKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 214 aa, Artificial Sequence
  CFP0020L233-010-k0
DIQMTQSPSSLSASVGDRVTITCRASQSIHNDLAWYQQKPRKAPKLLIYEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 281 - protein, 214 aa, Artificial Sequence
  CFP0020L233-011-k0
DIQMTQSPSSLSASVGDRVTITCRASQSIHNDLAWYQQKPGKAPKRLIKEASELQSGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 214 aa, Artificial Sequence
  CFP0020L233-012-k0
DIQMTQSPSSLSASVGDRVTITCRASQSIHNDLAWYQQKPGKAPKLLIYEARELQRGVPSRFSGSGSGTDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 214 aa, Artificial Sequence
  CFP0020L233-013-k0
DIQMTQSPSSLSASVGDRVTITCRASQSIHNDLAWYQQKPGKAPKLLIYEASELQSGVPSRFSGRGSGRDFTLTISSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 214 aa, Artificial Sequence
  CFP0020L233-016-k0
DIQMTQSPSSLSASVGDRVTITCRASQSIHNDLAWYQQKPRKAPKLLIYEASELQSGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 214 aa, Artificial Sequence
  CFP0020L233-017-k0
DIQMTQSPSSLSASVGDRVTITCRASQSIHNDLAWYQQKPGKAPKRLIKEASELQSGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 214 aa, Artificial Sequence
  CFP0020L233-018-k0
DIQMTQSPSSLSASVGDRVTITCRASQSIHNDLAWYQQKPGKAPKLLIYEARELQRGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 214 aa, Artificial Sequence
  CFP0020L233-019-k0
DIQMTQSPSSLSASVGDRVTITCRASQSIHNDLAWYQQKPGKAPKLLIYEASELQSGVPSRFSGRGSGRDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 214 aa, Artificial Sequence
  CFP0020L233-021-k0
DIQMTQSPSSLSASVGDRVTITCRASRSIHNDLAWYQQKPGKAPKLLIYEASELQSGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 214 aa, Artificial Sequence
  CFP0020L233-022-k0
DIQMTQSPSSLSASVGDRVTITCRASQSIHNDLAWYQQKPRKAPKLLIYEASELQSGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 214 aa, Artificial Sequence
  CFP0020L233-023-k0
DIQMTQSPSSLSASVGDRVTITCRASQSIHNDLAWYQQKPGKAPKRLIKEASELQSGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 214 aa, Artificial Sequence
  CFP0020L233-024-k0
DIQMTQSPSSLSASVGDRVTITCRASQSIHNDLAWYQQKPGKAPKLLIYEARELQRGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 214 aa, Artificial Sequence
  CFP0020L233-025-k0
DIQMTQSPSSLSASVGDRVTITCRASQSIHNDLAWYQQKPGKAPKLLIYEASELQSGVPSRFSGRGSGRDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 293 - protein, 214 aa, Artificial Sequence
  CFP0020L233-027-k0
DIQMTQSPSSLSASVGDRVTITCRASRSIHNDLAWYQQKPRKAPKLLIYEASELQSGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 294 - protein, 214 aa, Artificial Sequence
  CFP0020L233-028-k0
DIQMTQSPSSLSASVGDRVTITCRASQSIHNDLAWYQQKPRKAPKLLIYEARELQRGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - protein, 214 aa, Artificial Sequence
  CFP0020L233-029-k0
DIQMTQSPSSLSASVGDRVTITCRASQSIHNDLAWYQQKPRKAPKLLIYEASELQSGVPSRFSGRGSGRDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 214 aa, Artificial Sequence
  CFP0020L233-031-k0
DIQMTQSPSSLSASVGDRVTITCRASRSIHNDLAWYQQKPGKAPKLLIYEARELQRGVPSRFSGSGSGTDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - protein, 214 aa, Artificial Sequence
  CFP0020L233-032-k0
DIQMTQSPSSLSASVGDRVTITCRASQSIHNDLAWYQQKPGKAPKLLIYEARELQRGVPSRFSGRGSGRDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 298 - protein, 214 aa, Artificial Sequence
  CFP0020L233-034-k0
DIQMTQSPSSLSASVGDRVTITCRASRSIHNDLAWYQQKPGKAPKLLIYEASELQSGVPSRFSGRGSGRDFTLKISRLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 214 aa, Artificial Sequence
  CFP0020L233-036-k0
DIQMTQSPSSLSASVGDRVTITCRASRSIHNDLAWYQQKPRKAPKLLIYEASELQSGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 300 - protein, 214 aa, Artificial Sequence
  CFP0020L233-037-k0
DIQMTQSPSSLSASVGDRVTITCRASQSIHNDLAWYQQKPRKAPKLLIYEARELQRGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 214 aa, Artificial Sequence
  CFP0020L233-038-k0
DIQMTQSPSSLSASVGDRVTITCRASQSIHNDLAWYQQKPRKAPKLLIYEASELQSGVPSRFSGRGSGRDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 214 aa, Artificial Sequence
  CFP0020L233-040-k0
DIQMTQSPSSLSASVGDRVTITCRASRSIHNDLAWYQQKPGKAPKLLIYEARELQRGVPSRFSGSGSGTDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 214 aa, Artificial Sequence
  CFP0020L233-041-k0
DIQMTQSPSSLSASVGDRVTITCRASQSIHNDLAWYQQKPGKAPKLLIYEARELQRGVPSRFSGRGSGRDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 304 - protein, 214 aa, Artificial Sequence
  CFP0020L233-043-k0
DIQMTQSPSSLSASVGDRVTITCRASRSIHNDLAWYQQKPGKAPKLLIYEASELQSGVPSRFSGRGSGRDFTLTIRSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 305 - protein, 214 aa, Artificial Sequence
  CFP0020L233-044-k0
DIQMTQSPSSLSASVGDRVTITCRASQSIHNDLAWYQQKPGKAPKLLIYEASELQSGVPSRFSGSGSGTDFTLTIRSLQPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 306 - protein, 214 aa, Artificial Sequence
  CFP0020L233-045-k0
DIQMTQSPSSLSASVGDRVTITCRASQSIHNDLAWYQQKPGKAPKLLIYEASELQSGVPSRFSGRGSGTDFTLTISSLKPEDFATYYCQHYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 447 aa, Artificial Sequence
  Ab1H-P1394m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHKDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 308 - protein, 447 aa, Artificial Sequence
  Ab1H-P1398m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 309 - protein, 447 aa, Artificial Sequence
  Ab1H-P1466m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 310 - protein, 447 aa, Artificial Sequence
  Ab1H-P1468m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLRGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 311 - protein, 447 aa, Artificial Sequence
  Ab1H-P1469m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLKGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 312 - protein, 447 aa, Artificial Sequence
  Ab1H-P1470m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESRGQPENNYKTTPPVLDSDGSFFLYSKLTVDKSRWQQGNVFSCSVMHEALHNHYTQKSLSLSP

SEQ ID NO: 313 - protein, 447 aa, Artificial Sequence
  Ab1H-P1471m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESKGQPENNYKTTPPVLDSDGSFFLYSKLTVDKSRWQQGNVFSCSVMHEALHNHYTQKSLSLSP

SEQ ID NO: 314 - protein, 447 aa, Artificial Sequence
  Ab1H-P1480m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGRPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 315 - protein, 447 aa, Artificial Sequence
  Ab1H-P1481m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGKPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 316 - protein, 447 aa, Artificial Sequence
  Ab1H-P1482m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 317 - protein, 447 aa, Artificial Sequence
  Ab1H-P1483m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQKREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 318 - protein, 447 aa, Artificial Sequence
  Ab1H-P1512m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSRGSFFLYSKLTVDKSRWQQGNVFSCSVMHEALHNHYTQKSLSLSP

SEQ ID NO: 319 - protein, 447 aa, Artificial Sequence
  Ab1H-P1513m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSP

SEQ ID NO: 320 - protein, 447 aa, Artificial Sequence
  Ab1H-P1514m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDRSFFLYSKLTVDKSRWQQGNVFSCSVMHEALHNHYTQKSLSLSP

SEQ ID NO: 321 - protein, 447 aa, Artificial Sequence
  Ab1H-P1515m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDKSFFLYSKLTVDKSRWQQGNVFSCSVMHEALHNHYTQKSLSLSP

SEQ ID NO: 322 - protein, 447 aa, Artificial Sequence
  Ab1H-P1653m
QVQLVESGGGLVQPGGSLRLSCAASGFTLSNHDMTWVRQAPGKGLEYVSIINTYGNHWYANWASGRFTISRDNSKNTVYLQIDSLRAEDTATYYCARETHHGSSGIDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVRKSRWQQGNVFSCSVMHEALHNHYTQKSLSLSP

SEQ ID NO: 323 - protein, 448 aa, Artificial Sequence
  F8M-F1847mv1
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVMHEALHAHTTRKELSLSP

SEQ ID NO: 324 - protein, 444 aa, Artificial Sequence
  F8M-F1847mv2
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHAHTTREELSLSP

SEQ ID NO: 325 - protein, 214 aa, Artificial Sequence
  F8ML
DIQMTQSPSSLSASVGDRVTITCKASRNIERQLAWYQQKPGQAPELLIYQASRKESGVPDRFSGSRYGTDFTLTISSLQPEDIATYYCQQYSDPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 448 aa, Artificial Sequence
  F8M-F1868mv1
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVLHEALHAHTTRKELSLSP

SEQ ID NO: 327 - protein, 444 aa, Artificial Sequence
  F8M-F1868mv1
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHAHTTREELSLSP

SEQ ID NO: 328 - protein, 448 aa, Artificial Sequence
  F8M-F1927mv1
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVLHEALHAHYTRKELSLSP

SEQ ID NO: 329 - protein, 444 aa, Artificial Sequence
  F8M-F1927mv2
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHAHYTREELSLSP

SEQ ID NO: 330 - protein, 448 aa, Artificial Sequence
  Q499-z121
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 331 - protein, 444 aa, Artificial Sequence
  J327-z119
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 332 - protein, 214 aa, Artificial Sequence; identical to SEQ ID NO: 325
  L404-k

What is claimed is:

1. An isolated anti-IL-8 antibody which comprises (a) HVR-H1 comprising the amino acid sequence of SEQ ID NO:67, (b) HVR-H2 comprising the amino acid sequence of SEQ ID NO:73, (c) HVR-H3 comprising the amino acid sequence of SEQ ID NO:74, (d) HVR-LI comprising the amino acid sequence of SEQ ID NO:70, (e) HVR-L2 comprising the amino acid sequence of SEQ ID NO:75, and (f) HVR-L3 comprising the amino acid sequence of SEQ ID NO:76.

2. The anti-IL-8 antibody of claim 1, which is an IgG antibody.

3. The anti-IL-8 antibody of claim 2, wherein the IgG antibody is IgG1, IgG2, IgG3 or IgG4.

4. The anti-IL-8 antibody of claim 3, wherein the IgG antibody is IgG1.

5. The anti-IL-8 antibody of claim 1, which comprises one or more amino acid substitutions selected from the group consisting of: L235R, G236R, S239K, A327G, A330S, P331S, M428L, N434A, Y436T, Q438R, and S440E, according to EU numbering.

6. The anti-IL-8 antibody of claim 5, which comprises amino acid substitution N434A according to EU numbering.

7. The anti-IL-8 antibody of claim 6, which comprises amino acid substitutions of L235R, G236R, S239K, M428L, N434A, Y436T, Q438R, and S440E, according to EU numbering.

8. The anti-IL-8 antibody of claim 6, which comprises amino acid substitutions of L235R, G236R, A327G, A330S, P331S, M428L, N434A, Y436T, Q438R, and S440E, according to EU numbering.

9. A pharmaceutical composition comprising the anti-IL-8 antibody of claim 1 and a pharmaceutically acceptable carrier.

10. A pharmaceutical composition comprising the anti-IL-8 antibody of claim 5 and a pharmaceutically acceptable carrier.

11. A pharmaceutical composition comprising the anti-IL-8 antibody of claim 6 and a pharmaceutically acceptable carrier.

12. A pharmaceutical composition comprising the anti-IL-8 antibody of claim 7 and a pharmaceutically acceptable carrier.

13. A pharmaceutical composition comprising the anti-IL-8 antibody of claim 8 and a pharmaceutically acceptable carrier.

14. An isolated anti-IL-8 antibody which comprises a heavy chain variable region comprising the amino acid sequence of SEQ ID NO:78 and a light chain variable region comprising the amino acid sequence of SEQ ID NO:79.

15. The anti-IL-8 antibody of claim 14, which is an IgG antibody.

16. The anti-IL-8 antibody of claim 15, wherein the IgG antibody is IgG1, IgG2, IgG3 or IgG4.

17. The anti-IL-8 antibody of claim 16, wherein the IgG antibody is IgG1.

18. The anti-IL-8 antibody of claim 14, which comprises one or more amino acid substitutions selected from the group consisting of: L235R, G236R, S239K, A327G, A330S, P331S, M428L, N434A, Y436T, Q438R, and S440E, according to EU numbering.

19. The anti-IL-8 antibody of claim 18, which comprises amino acid substitution N434A according to EU numbering.

20. The anti-IL-8 antibody of claim 19, which comprises amino acid substitutions of L235R, G236R, S239K, M428L, N434A, Y436T, Q438R, and S440E, according to EU numbering.

21. The anti-IL-8 antibody of claim 19, which comprises amino acid substitutions of L235R, G236R, A327G, A330S, P331S, M428L, N434A, Y436T, Q438R, and S440E, according to EU numbering.

22. The anti-IL-8 antibody of claim 14, which comprises a heavy chain comprising an amino acid sequence selected from the group consisting of:
(a) SEQ ID NO:80;
(b) SEQ ID NO:81;
(c) SEQ ID NO:92; and
(d) SEQ ID NO:93.

23. The anti-IL-8 antibody of claim 14, which comprises a light chain comprising the amino acid sequence of SEQ ID NO:82.

24. The anti-IL-8 antibody of claim 14, which comprises a light chain comprising the amino acid sequence of SEQ ID NO:82 and a heavy chain comprising an amino acid sequence selected from the group consisting of:
(a) SEQ ID NO:80;
(b) SEQ ID NO:81;
(c) SEQ ID NO:92; and
(d) SEQ ID NO:93.

25. The anti-IL-8 antibody of claim 24, which comprises a light chain comprising the amino acid sequence of SEQ ID NO:82 and a heavy chain comprising the amino acid sequence of SEQ ID NO:80.

26. The anti-IL-8 antibody of claim 24, which comprises a light chain comprising the amino acid sequence of SEQ ID NO:82 and a heavy chain comprising the amino acid sequence of SEQ ID NO:81.

27. A pharmaceutical composition comprising the anti-IL-8 antibody of claim 14 and a pharmaceutically acceptable carrier.

28. A pharmaceutical composition comprising the anti-IL-8 antibody of claim 18 and a pharmaceutically acceptable carrier.

29. A pharmaceutical composition comprising the anti-IL-8 antibody of claim 19 and a pharmaceutically acceptable carrier.

30. A pharmaceutical composition comprising the anti-IL-8 antibody of claim 20 and a pharmaceutically acceptable carrier.

31. A pharmaceutical composition comprising the anti-IL-8 antibody of claim 21 and a pharmaceutically acceptable carrier.

32. A pharmaceutical composition comprising the anti-IL-8 antibody of claim 22 and a pharmaceutically acceptable carrier.

33. A pharmaceutical composition comprising the anti-IL-8 antibody of claim 23 and a pharmaceutically acceptable carrier.

34. A pharmaceutical composition comprising the anti-IL-8 antibody of claim 24 and a pharmaceutically acceptable carrier.

35. A pharmaceutical composition comprising the anti-IL-8 antibody of claim 25 and a pharmaceutically acceptable carrier.

36. A pharmaceutical composition comprising the anti-IL-8 antibody of claim 26 and a pharmaceutically acceptable carrier.

* * * * *